United States Patent 11,396,665 (CRISPR-CAS SYSTEM FOR A FILAMENTOUS FUNGAL HOST CELL) - sequence listing, part 46

SEQ ID NO: 3 - DNA, 28249140 bp, Rasamsonia emersonii CBS393.64 (residues 26,231,349-28,249,140 of 28,249,140)
  misc_feature (753870)..(753870): n is a, c, g, or t
  misc_feature (2140863)..(2140863): n is a, c, g, or t
  misc_feature (2948226)..(2948226): n is a, c, g, or t
  misc_feature (4564360)..(4564360): n is a, c, g, or t
  misc_feature (5626366)..(5626366): n is a, c, g, or t
  misc_feature (6036055)..(6036055): n is a, c, g, or t
  misc_feature (6399382)..(6399382): n is a, c, g, or t
  misc_feature (6968436)..(6968436): n is a, c, g, or t
  misc_feature (7755611)..(7755611): n is a, c, g, or t
  misc_feature (7788543)..(7788543): n is a, c, g, or t
  misc_feature (7911310)..(7911310): n is a, c, g, or t
  misc_feature (8070523)..(8070523): n is a, c, g, or t
  misc_feature (8703952)..(8703952): n is a, c, g, or t
  misc_feature (8869463)..(8869463): n is a, c, g, or t
  misc_feature (10635451)..(10635451): n is a, c, g, or t
  misc_feature (10715481)..(10715481): n is a, c, g, or t
  misc_feature (13008178)..(13008178): n is a, c, g, or t
  misc_feature (13441708)..(13441708): n is a, c, g, or t
  misc_feature (13788191)..(13788191): n is a, c, g, or t
  misc_feature (13951317)..(13951317): n is a, c, g, or t
  misc_feature (16486333)..(16486333): n is a, c, g, or t
  misc_feature (16711684)..(16711684): n is a, c, g, or t
  misc_feature (16849736)..(16849736): n is a, c, g, or t
  misc_feature (16849740)..(16849740): n is a, c, g, or t
  misc_feature (16849742)..(16849742): n is a, c, g, or t
  misc_feature (16849744)..(16849744): n is a, c, g, or t
  misc_feature (16849746)..(16849746): n is a, c, g, or t
  misc_feature (16849748)..(16849748): n is a, c, g, or t
  misc_feature (16849750)..(16849750): n is a, c, g, or t
  misc_feature (16849753)..(16849753): n is a, c, g, or t
  misc_feature (16849755)..(16849755): n is a, c, g, or t
  misc_feature (16849758)..(16849758): n is a, c, g, or t
  misc_feature (16849760)..(16849760): n is a, c, g, or t
  misc_feature (16849764)..(16849764): n is a, c, g, or t
  misc_feature (17700029)..(17700029): n is a, c, g, or t
  misc_feature (18220582)..(18220582): n is a, c, g, or t
  misc_feature (18252424)..(18252424): n is a, c, g, or t
  misc_feature (18354857)..(18354857): n is a, c, g, or t
  misc_feature (18354859)..(18354859): n is a, c, g, or t
  misc_feature (21432985)..(21432985): n is a, c, g, or t
  misc_feature (21585323)..(21585323): n is a, c, g, or t
  misc_feature (21658237)..(21658237): n is a, c, g, or t
  misc_feature (21869468)..(21869468): n is a, c, g, or t
  misc_feature (21869470)..(21869470): n is a, c, g, or t
  misc_feature (21869472)..(21869472): n is a, c, g, or t
  misc_feature (21869474)..(21869474): n is a, c, g, or t
  misc_feature (22207993)..(22207993): n is a, c, g, or t
  misc_feature (22559041)..(22559041): n is a, c, g, or t
  misc_feature (24102115)..(24102115): n is a, c, g, or t
  misc_feature (24169395)..(24169395): n is a, c, g, or t
  misc_feature (24600649)..(24600649): n is a, c, g, or t
  misc_feature (24628979)..(24628979): n is a, c, g, or t
  misc_feature (24628987)..(24628987): n is a, c, g, or t
  misc_feature (24663179)..(24663179): n is a, c, g, or t
  misc_feature (24663190)..(24663190): n is a, c, g, or t
  misc_feature (24786340)..(24786340): n is a, c, g, or t
  misc_feature (24980131)..(24980131): n is a, c, g, or t
  misc_feature (25011863)..(25011863): n is a, c, g, or t
  misc_feature (25115997)..(25115997): n is a, c, g, or t
  misc_feature (25126404)..(25126404): n is a, c, g, or t
  misc_feature (25215710)..(25215710): n is a, c, g, or t
  misc_feature (25271962)..(25271962): n is a, c, g, or t
  misc_feature (25386608)..(25386608): n is a, c, g, or t
  misc_feature (25386611)..(25386611): n is a, c, g, or t
  misc_feature (25386614)..(25386614): n is a, c, g, or t
  misc_feature (25412387)..(25412387): n is a, c, g, or t
  misc_feature (25415472)..(25415472): n is a, c, g, or t
  misc_feature (25415490)..(25415490): n is a, c, g, or t
  misc_feature (25415504)..(25415504): n is a, c, g, or t
  misc_feature (25415508)..(25415508): n is a, c, g, or t
  misc_feature (25494830)..(25494830): n is a, c, g, or t
  misc_feature (25557799)..(25557799): n is a, c, g, or t
  misc_feature (26691391)..(26691391): n is a, c, g, or t
  misc_feature (27018744)..(27018744): n is a, c, g, or t
  misc_feature (27668937)..(27668937): n is a, c, g, or t
  misc_feature (27835568)..(27835568): n is a, c, g, or t
  misc_feature (27837261)..(27837261): n is a, c, g, or t
  misc_feature (28096384)..(28096384): n is a, c, g, or t
  misc_feature (28189748)..(28189748): n is a, c, g, or t
  misc_feature (28229683)..(28229683): n is a, c, g, or t
cttcttgtggaccagggcagtcaggtcaccgccgtcgtccaggatcaggttgagcttctttccatccttgaaggcgtgcagctgctgctccaagcaccagttgtactcctcctcagtctctcccttccaggcgaaactggtcacacggcattgtcagctacgtggtccggagagacacgcaatctcaacaggaacttacacagggataccggcagcagcaatggcggcggcggcgtggtcctgggtggagaagatgttgcagctcgtccaggtgacctcagcaccgagagcgaccagagtctcgatcaggacagcggtctggatggctacaggacatgtgagtaaagcaatcgcctgagcagacagaattgtcgaaaacttactcatgtgcagacaaccggcaatacgggcacccttcaggggctggtcgggagcgtacttcttgcggatggccatcaaaccgggcatctcgacctcggcgagctcaatctcgcggcgcccgaaggcagccagggactgcaagcaagtcagcgattttctgggagatcagggaggggcaatggccacctacgatgtctgcgaccttgaacttgtgggcgggggcgctcatggtgacggcttagaggggactgaggggtgaagtctgcgtgagagagttagttcgccttcagataaccggcaggcctgttaaaggcggatcgactgacaggaataaaatgggcgaggggggtatggggtggtgagagggagaagagaaaagatggacgggggaagaggggaaactgttttggcggtcggcggagaaggagaaggagaaggaggggctgccgaagaatctgcttcaccgccggccactaagcgctgccggacatctcctccgccgggctccgtgctcaggccattggcgtgcaacgtggtcgcttgaagaccccacaagcatcaacattttctctgcatctttgaatgctacatcgtggatatcgatgccatctacagatgatctcggcatttctgttcggactgtgtgctgattactccgtatggaattagatagcgttccccgcctcgcaccaaaagcataaaagcacctgagcagccacctttgtctgtctggttttttctcacctgaaaaaaatcgagataacttctattctcaatggaagaagtaatatgcaagggaatatatcaagctgactgccgtccgtacggagtgatactcgttctttttttgtttgtcagggcatatcgcgaaattgtggggcagacctgcttacgtaggatagcaaccagcttaggtacagcgtactctgtactagctaggtactaacagcagtagcttctttaatattatacttgcgatgatgtgaaccgataatcgcagatcaatttaatctggtggttttttttttcaattcaaacaaggcttcaggtgtcctcatctgacacctcttgtcagccccacgtggataccctctaggccaggcatgcagagtatctatgcataaggtcctgcaatgcattctgtttgggtgaaatcaattgcagtctgaactgatacctcagattaggtaagatcactcactgcctgatattagtgcttacctatctaagtagatcatagcaaccgctaagatgtcagcctcgccgtattacttttatcacgtgtcgaggcacaatatgccattctcacctctgtcagatcgatcaatcccgatcagaatcaaagagatcataccagacctgcctacctaccaaggtaggtaattacaacaagctgtcctgcaacagactccaccatggaccccttccctccaagcgtctcctctaccgcgcctacaacgcccccaaggacgacgacttcttcctcgcctgccatggcgatcccgccatcgttctgcatgccgccaagaacctccccaagccagtctctcggcagacaatcgaggagtaccgcgcgacggcgcagggtgtgctgctgttcgtggtaatctgcaagattccggacgaaaacaaggctcccgtcgagccggaaccgatcggtctcctatccctcagacaagccgctgcggaccaggcccatcatcgcagtgcgatgctgggcatcgagatcaagcgcgagcaccacagccagggctacggcaccgaagcctccgtctgggccgtcgagtgggccttcaagacggccaatctgcatcgcgtcgagctgcatgtgctcgagtggaatgcgcgcgcgcagagggtctacgagaagatcggattcctggtcgagggccggctgagggaggccctctggctgaatggtcggtggtgggatgagatcgttatggggatgttggacggcgaatgggaggagttgcgggagcgtcatatcgacgaagctctattactgtctgtatgaagtatatttggctatgtctgtaagaacgctttaaacagaccagacagctagacgctagaccaataaatgcagtgcaaatgcaacaacagcatggtatcttgaacgaacaaggtctaaatttcgatctcatgtcataaccaaaaaaaaaagcaaaatcatacgctgccacaagtgactgagaagctatgcatcctcctcagtccactcactaatctcccacgacgaggcatcatcatcaatgaccagcttcagcgtcgaaaacacaatcttctcatacatttcgcgggcggcggcccgggcttgctggtgccaggggcctgtgcctccggcgtgcgcatcctctctgctgcgccagatgcctgtcatgaagttagtttgctattcattcatcagaaaaagctgctgtatgtacttacaggtcgccaaattccgatgcttctcatccttggtcccaaaccagtacttcaacagaccaccgctggcagtggcctcctgatgcgaacgcacgtcgagatcatgcaagcgctgctggtcaacgtcggggaacagctgcgatcgaaaggtgacgacatagaacttctgcctcttccaccggtaaccctcggcctgggagagatcgcgcagaaagtcgacgacagcctgccagttgaaggactccgtatagggcgcggtggcgtagtcgtcgcgcacgggcttgaagatggtcagcgccttggccagcagctggttgggcgtgtccagacgcttgaggtcgagcagatggggttcttcattgtaaggggagacgatgagccggtcgtcggacggggcgacgtgctcgtggcgtcggttgccgaattgcaactgcagggacgcagcggcgtggaacttgaggaggttaaagtccttggtgacgaggctgtggtggaagagagaagtcggtcccgtgagagtgactttgggcgtattcgacgccgggtttgttgtttctgtcgtgaccacgctccctactgcgggagccatttcgttcgttgactacgggtgaatacagccagccctaggaaagcagaatggaggctttaaaatgttgatcttgggaattaattttggaagcgagcaaattcgctcaattggcgagaaacttttgtatattccgcacagtacaaatgtgtccagaagtgtgttcaacagacaattgaagtatgtatgcacgaaaggacaggaactcgaagcaagaaaataaaatcgaaagcaaagaaagaaaaatcagaacgagttaactgaacgacatcaatgattcattagagacataaatgccatcaccttctttctattaattagcccacaaaacagtgtacgcaagccaaatcaaataatatatatacgctggcaaaggctggcgaagaaaaaaaaattgcgtgcgcgcgcacaaacgtagtaccacgagcacgcaatatcctgcaatccgtaagcaatcaacgtctttttttttctcgttggcttttgggttttttcgctttccttggtttgggtcggaaaaatgtcaggtacgtaaccatggttaaaaacagcccaccgggaagcgtaaaataagaaaatcccgccgttaggttgaactctcattgtcataatattgctcctgtacaacggctaggtggcattgttctttctttctttcttgctttctgtcttttccctgaactctgacaagcagggaaatcttacagtaggtaggaatagcggtgtcgtctagatgtcactgttgtccaagtgagacagtgacatcttggcgtatccacctttcttaggaagaggatggttacaagagggaagaaagtgtatatatgtgggggatcttccgggtatttatagggtttccctacaaggtgactctgctttgatcgtggtgtcaaaataactattaaaaataaaacaagctgcttcttcgaataagaaatattactctgatgtgcgattatctcgtctaggatgatgtttcgtgactcggttcgccatcggctgatcacgccatcgtccatctcgccaatcatctcgcagcagtctacagcctcatacaacgccctcaggctcatcgattatcttatcagtggacagaataaatacttccataccctaacaaggcctctctaaaacacacatgtactgtacatacaaactagaataatggtatcatgcaagcagtcatccagttgtcgcagcatcccgaacgcccgataatgcaccgtagagaagaacttttcgtgtatcagagacataaaaaaaaggaggaaatcactttttaaccggaactggaggcggcggcatcttgccctcgcctgtatcaaccttcttccgggctgggatttcgggcactttgaaccctgcactatcgaccttcccagcactgctctgattgcccacctgcgtgaaagtcccgctcttgaaccatcggtcctcctcggccttgcgcttgcggttgagctccgcttgaactttgggatcaaccaactccaagccctgcacgggcgtgaatgcaagcgaactggccgtacctgccggccctgctcccagagttggaccaacacccgatgtacggagacccttggcctgaagaaccgacgcactgcccggtccaacgccccgaagcgacgtcgccgtaccgctgagcggggtgatgccgccccagcctttgttggacttgctgagtttggcccgcgtgcgttgatcgatctgcgtggcgcgaacacggccgtcgttctcctggccgagcatcccaagcccgatggtctcttctccggttccatagccggcttcctgctcctctttgccaaaggccactctgttctgggctttgcggagctctgtcatcgccacggcttccttggccttacgagcacgtcgtcctcctcgctttcgggatggcttgtcgtccggcgcagggagcgcacggggacctctgttcggtggtggctccgtcagtttttcaagccgttgaaagcactgccgcttgagctcctcccccatcgaaccgtcgggactggatcgagcgacatcagctctggcagcaagcaccattttggcggagacgatgcgcatggcctggcgcttcagatcgtttggaatgctctggatgatgggcgagtggtacagaaatccttgctgccggattcccacgttggtcgcaaaccccaagccttcctgcttctttgacccttgtgccgccaggttacatgcgggaatcttcgcaagctccatgagtccaccggcctggttcaaaaactgagcagcagtctgcggcccgatcaaggcggtcaggttcggcgcgatttcggtcacacgagactggacgctttcaatgcgcgccgttcgctcccgatccagcttcaagattttctcgcaggtgtcgcgaacaatcttcagctccgcctcggtcatttctcggccgcgcgtcgtcgttccttcgaccgcgacaaccatcaacgatggcccatccagaatggatttgagcggcaccccgaccatgttgtctgacgagttcgccagctctttgatgttgttgagcgggccattttgcaagatagcgactgtttttgcgtagtcgataggattcgtaatcagagtctcgagctctggaaatcgaatcgagtagtggtcgcgcagcactttgtgtagtcgtgagagttcatcggccgtggacatggcaacctcgaagtcattcttcaccccagtgtcttccctgctgggctcgtccttctccgccacattctcgccttcctggaggccttcgttctcctggaggccgtccgcctccaggtcctccatatcctcctcaaaatctctcaagagctcgtctgcggctgacatggtggcggctagctgtaggatgcaggaagttggagtaaaagcaagcaagcagtgacgccacgagaagtactgaataagtgactgcggtagcgcagattttggattacataatcacgatgtctgtggtcatgtgatcacagactttatgcctgagaaagcaggcagcagttctctcgaagttcccgggtggcgcgaaagacctcaactgcaactttgcgagagcatgtttcgctctccagcctgtccaaagaccaacccgtggtcagcttggaccatcaagctccgggggatccgctgaagaaataaggatctgttctcctttgcctttctcgattttatattcctttttctttctacgttcttcgtccgaccgaacgcgttgccagccctcgttcctccgatattgactccgtcctagattgagaacgtgtctaacagtccaccaccatggattcatcacgagggccccccagggtcaaaaacaaggcgcccgcgccgatgcagatctcagcggagcagctgctccgcgaggctgttgaccggcaggagcccgcgttgcaggtcccgacccagcggttcgccgatttggaggaactgcacgagtaccagggacggaaacgaaaggagttcgaagactatgtgcgccgcaatcggctgaacatgaacaactggatgcgctatgcgcagtgggaacttgagcagaaggagttccgtcgggcgcgctccgtctttgaacgggcgttggacgtgaatccgacgtcggtggtgctatggattcgatatatcgagtcggagatgaagaaccgaaacatcaaccatgcgcgcaatctgtttgatcgggcagtgacgatcctgccccgggtggataagctgtggtacaaatatgtctacatggaggagacgctgggcaacattgcgggaacgcggcaggtgtttgagcgatggatgtcgtgggagcccgacgaaggcgcctggagtgcctacatcaagctggagaagcgataccatgagtacgaccgggctcgggcgattttccagcggttcacgatggtccacccggatcctaagaactggatcaaatgggcgcgatttgaggaggagtacgggacacccgatcttgttcgcgaggtgtacgggctggcaattgaaactctcggagacgacttcatggacgagaggatctttatcgcctacgccaagtacgaaacgaagctcaaagagtacgaacgtgcacgggcgatctacaagtttgcgttggaccgactgccgcggtcgaaatctgtggctttgcataaggcctacaccacgtttgagaagcaattcggtgaccgggatggcgttgaggatgtcatcctggccaagcggagagtccaatacgaggaacaactcaaggaaaatccaaggaactacgacgtctggttcgactttgcccgactggaggagtcggccggggacgtggatcgcgtgcgggatgtgtacgagcgggcgattgcgcagatcccaccgtcgcaggagaagcggcattggcggcgatatatctacctctggatcttctacgccatatgggaggagatggagaataaggacgttgaccgggcgcggcagatctaccaggaatgcctgaagctcatcccgcacaagaaattcacgtttgccaagatctggctcatgaaagcccacttcgagattcgacagatggacctgcaggcagcgcgaaagacgctgggccaggcgattggcatgtgcccgaaggacaaactgttccggggctacattgaactggagaagcagctttttgagtttacgcggtgccggacgctgtacgagaagcagatcgaatggaatccatccaacagccaggcctggatcaagttcgcagagctggagcgggggctggacgatctggaccgggcgcgggcgatcttcgaactggggatcgagcagccgactctggacatgccggagctggtgtggaaggcctacatcgactttgaggaatacgaaggagagtatgatcgggtgcggcagctgtacgagcggctcctgcagaagacggaccatgtcaaggtgtggataaactatgcgcggttcgagatcaacgccccggaaggggacgaagaggaagacgaggaggaggagaggccggtgagcgaggaagccaagcggcgggcgcgcaagattttcgagcgggcgaataaggtgatgagagaaaaggatctgaaggaggatgtaagtgccctttcttgcggatacctttcttgcggggattcggccttggctaacgggtgtacagcgtgtggagctgttgaatgcatggaagtcgttcgagatgacgcacggatcgcccgaagacattgcggcgatcgagaagcagatgccgcggcgggtcaagaagcggcgcaagctggacgacgaccggtacgaggagtacatggactatgtgttcccggcggacgaccaggcggcggcgaacctgtcgcggctgttgcagcgcgcgcaccagtggaagcaggagcagcagcagaagcagcagcaggcggagcaggctgctgggtaggcgtgaagcaagtcgccgcgaagcgagtcttcgcgaggagagtgattgtccaagtacagtgtccgtcagtggtagtatagcacgtcatctaatccaatcagtaatcttttctttcatttggcagatgctagaagctggagccagacaagcaggcatggcatggcatttgatgccaatgatgccgatgaatggggccaaaattatcccactaggagcgcaggaactaacgctgtacagagcagaaagtacagagtacatacatacaaagtaggaagtacgtatattaggtccattttccctgcatagatgcagatgatctacatagagcacacgtgaagaagaagtgaactaaaaatcaatcaatcccactaccgagtcggcagttggctagtcgagtagtagtagtgtcagcagttcgtcaggtccgtacctacctaggtagtctagtcctctagtcttagtcttctaagactaatcttgggggcgatatgcacgcctatctgcatgtgtgcatgcatgatagtaggtctgaatattcaggtaggtcggtacctaactcggtagttgtgatcactgtgactatatcacctgacctgcccagcaggtactccatacatgtaggtaccttaggtaggtagctaagaattcgaccacatggcctgaaaaataagaattgtggatacctgcgctagacaggcagatagacagacagacagacaggaagataaatagatggttatcagtgcaagtgcaataatggttactaggaaattaagtctatgtacgtccgtcctaacttggataactacctagttgaattcgagcacgaatttttttttaaaaaaaaaagaagaagaagaaaaatgacaatagttagataatatatacctatacaggtagctagtcgactgaactgtccagcataaattgacaatatcgaatactgataattgacgaacaacggtcgcccacgtgcatggccccgtgcaggctgccccgcccggcccgattctactccgaggatgctacaacacacctgttgtgttgtaagaatcatgagaatatcacttaatcaggcaagatatagtagtaatagtagtagttatggcatgttatttatttatgaggtatgtacataggtatataggcaggtacattccaagtgagacaagtctcacagtgggtggtttgactcgccaagcgaaggatgaggcggggaaataatatctacctaacctaccgagtaaaattgtacccacaggtcgtttacggagtactgagttagtatgtaccataaacaaaagagttaggtgaattttaatataacacgattccttctagaattctccaccctacattatcccgattcagtggctgatcttcggtaccggtggtacggtgtagatggatcgaagtgactcgagtagcctttcctggtaggtatttttattattaggtaggtatcattcgagtaagggcccctttcattctctactatcattcctttattattagcatgctgctacctctgccatgccctgccatgggggctgaaagggcatacggaatgcagcaataatgctggcaagaatgtccccctcgcttgtcttccttcataggtatccctcactgcatgccataatcctgcggccctgccatccataattagctcgatggcccctcacgtccgtgcgtgaagaaatgacgttggcggacggggaccctgagtgccgcccacgttggcgactgaattcctccgttatcggggcagaatctaattaattaagattcttagtcaggcacggttcccggttcaccgtggcgtgccctgaaccgtgaactctcgccagccacgtcgaactggatggaaatttcggagtccgtaagacggcagaataccaacatcggcgataattgagtggctggaggagatcctggcaggcgggaataataattcacccctttccccgtggttggtacatggagttggagtttggcgtaaggagtcaattaatcgatccttcagtatgaatgtgttgttctagcagatgagatggataccggatttggtgtgctccgtcgatttatctcgtgacggagtgtatctcatccgattcacagcactcggatatctggacagcgtaggagactccgttgaagtcacggtgggatcgcggtgaatatcacgcatgcccatggggccatccagtcgtcgtgcctggcccctgagcgccggcgcaggagcggcgcctcggttgcgcgaatcgcgccacttagcgtggttggcgcggtggaggacgctgcagaacactgatcggcctggttatcgtcggcgaggatgtgattcctgtggtgtgctctgccagtcgcggtgcagcgtccaggcgtggtgtgatgatggacgattttggtgataatcacctctcgtggggtccagatggaggcaccaggacgaagtactctttaccgtaggcacatcattcatccagaatattatacagagtactccgtattatccagtattatccagtcctcgtaattagtcgcctacacggagcacagcaagtggatggccgggccccgttgtttcacttgatctcccttgcgctgcccgagcccgctagcagccccttaccacggtctgctctctgtcaactctcccagctgcacgcctcttctgtctggcgctgcgtgccatccctctctttccttttccatctgttcccagctcgtctgcggacagtttcgtttccagagcaccgcgtgtgccgcaggcgacgttctgccagactgcgtccgagtcgactcgtcctatcacgatcgcttcgttacgagaagacgatagaaaagagatttcttcgatttcttcgatagacgattttctccgactgtcgtttacggttagaaacgcgttctgtgttttctcgttcggtttctggtttcgactcgcgcaggcgtctactcgcatcgctcactccaccatgagatagtactctggcagccagtccaccacatcacgatttcgcgactccgtccaggccgttcttttgcccatcctgatctccccgtccactccttgtccccgtcttctgctggcgtcctcgaaggccgcctaagcgaccatgtctctccctacgcccccgtccgccctggaggggcattgctcggtcgtctacaacaacactctttacgtctacacccccaaggccttcatgtccttgcccctcgagctgcacggcaattggtcctccttgcccatgggcgaatcggtgacgggcgcggaatgtgtcaagggtgggatcaacggcgacaacacgcaggctgccctgtatgtcgtcggaggcaccgccagctcgtccgattatccgggcctgcagcgatacttgtttgaacagcgtcagtgggagaccatcaagcccgtgaccacggtcacccagagccgtctccaccacggcgtcgcctatctgaacgcctcgtcttccatcctcgtctacgccggctcgcagaacggcgacgccggtgcttcgaccgagaccttcaccatctcgaccgtgccgccgtacgccgttcaggcctacaattcccagggggctccgcccgcagtatccccgtcgttgcttccgtgggacgacaagaccgccgtctatgtcggcggcaatccatcgaacaccgaggtcttcctgttcaccccttacggcggctggcagccttcgggtgtctcgctggctaaaggaattccgagcaatgccgggctggccatgattctgggtgctgatgggagcaaggtcctggaaacgtttaatatgagtgtgtccccaaacacggtcacgtcaatcgctctggtagactccggtggtgcacctgcgccccctgggcaagaagtgggcgtcgacaccggctcttcttcctcgtcgacacgcaaaaggaaacgcgcaggtgtggccaacttcccggcgtacaatggcaccttcgcaccgacgacgactcgcagcgacttctccgtggcgcaatccgacaatggcatggtcgtcatttcgggcgggagcgacacagaccctctctgcatcttcgaccagacgcagaacagctgggtcaatgtgaaccagttgttcaatggcaaagaggaaacgcaacaaccgcttatcggcatcacgagcagcccgacaagcacgtcggcaacggcgaccgctacggcgacgtcgtcttctacctcgcagtcctcttctgccgccccgacagccgtggccgcgccgccgagtggcagctcccgcagcgccacaggtaccatcgtcggcgccacgctgggcgctttgtgcggcgtggcagtgttgctgattataatgttgcttgtccttcgacggcttcgacagaagaaggaagcggcggccgggaaaggttcttcgcgcggttatccaggggacgacaaggatcgactaagcttccaggaccaggggattgagcccctgacgcaatccgcatttcccatggggatggccccggcgccatcggtcgactcgttagctatcatgtcggggaaggtgggcaacgagaaggcttcgcctgtggtcaagaacaacccatatgggcgacctctggttgagcagaacaagagccctttatcaccgatcgcttccagccggggagacggggtcaggagtgcagcttctggcatggaacggaatctgaccgctcgtccgccggatctgaatctgcctcgcggcggcgaccggaggacggacgaaggctggagcaagtatttccaggacaactcggccacgaacctcgcggcggggatgcaatccgcgcggtcgaccatctcgtcgcaggcgtcgcaagagacgagatcggactatcggagcagcgtttggccgcagacgatggaaaacagcacgctcgatctggatttggaggagccgagacctcttggccgcgtgaacacgggcagtcccagcacggagcatctgccggaccaccaagggcagtcggccaagatctcgagcgccgactcggccagtctggcgtcggaggaggagcgcgatcggtattcggaggtgccggccaacgtcgccaacggggagaatccgtggtggactgtacggcctcccagcagtaactacacggcgagttactatcagcccagctcgaggcgggagacgacgtactcgcaggcgaatgaagggcgatcgacggaccgacgggggtcgagtgccgttttccacgaccaatttccgccgccgccggcgaacagcaatatcaacacggacatgagctggctgaacctgaatgccgaccggtaggtcgaccggtaggccaccgataggcagacggatagtgcagttatctgttctatctcgaggttcgatgttacgaatcactggatgatccaaacaaaagttttgcatcctttggcctgtcaggctgtacaggcagcactctagatgagcttggccagacgaacctggcgagtcttcgttttgttgtacagtccaagacgactgtacctgcacggtcagataccatgcatttctgcaccccttattttttttcttatctagtgttcatccttactacttgcatggctgtacatgtaatccatgcttcttttttctttttctatctgtctgctggcaagcatctttcctacctacctgtctgtctgtctgtctgtctgttcgcagcgcgctgttcgtcttcgtagttggtcgttccttgcataccctgcacgagcatcgtttccactctttttcgtgtttggcaaagcatgcattgcatgttgggttttgtcggatggattgattggcttgaggatttgcatgtttttgtgacttgactcctgggagggtcatgtacatactatatacacttgttactgttgttgtgctgtgctgtgcttgcttgcttgctctactattaccgcgagttcggtctggttaacctgttaacagttggtgggcgtgttgtatggacggaataagattaagagttgaattagaaaatgttaaatcggaaaggaatacgaaataaacgtaggaagtaaaaagactgtagtgtagtagtgctagtatagtatatcaattgatctggtcaagacaagacatggcatggctgactaacctacggagtactatcaatccatccgcatgaatcgactattccgtcctattctagtttcaattacaagcattgtttattttttcactcacgagatgaaataaatcgacagagtcgagtggacagggatcttcgattctgtctggtctgtaactctgtattgtgtccagatcagatgacattagatcagatcttagtaaagatcaggtgatgtcaggcagctgctatctttttttcattccatttatcaattttaattttcttttttcttttgtgacaacatctcaaccgtcgaggacggacgctacatatacattatccatggaatctgtcttgtgctgtcccatactaggctattctattctatctattacttcataagagaacccttgcaggtatagctattgtcatacattacacccacatacataacagacgttagacagctgctgtctgagccattgtctttgtttgtatttgtatctgtctatgtgtttatatatatatatgtatatgtatatgtatataaccataccttattcaagtcacgggcatcgcatgtgacttaggtaggtagctggggatggaaccttcatgctttctgtcaaaggtccttcttccattgtgaaagctgcattgtactgtactgcgacatctgttttcttgtttttgttttaatttacttcctttttttggtttttttcctctactgatcactatgtagccttattatctggaaagaaagaatgaaaagtgaggaaaatgaaatcatgtcgagttagacctaggatttggatttggattttgatttgcagtattcagtcagtatttagatttagaaattagaattgttatcattctgatcttcgaaacaattgttctttctttctttctttctttctttctttctttttttcctctttttttttttaaaattagtagtgttaactatgatgtctactgagttagtcagtccgtccgtcagaatatatatatgtcattgattattcacacatgacagtgacagccctgctaggtgcataccgactaccaacctacctgtacagtattacctaaggtaattaccccatactccataaccaatactccatacctagtagagatcgatatcaccatcatccattgatagacaacgataactattattggtagatagtagttatttcagtaaagaaaaaaaaacaagaatcaacgatgacaaattccatatgcacctgtacaaacacgtcaagtacatacagtactaataattaaatccacgttcgaatttcgaaaacgatgacaaatacctctatcatcaactaggatgacaaatacctcagggcaattctcgaagcttaagctttggcttggcttagctaagctgggtatagcttcgtccccaagctactgtaacctaccaaatctaacgaactttacttggtatgactataatgtgtcctgtccattcagcctctttcgtcattgattttgtatctttcttccttttcttttgtttttatcgtggaatccttcgaacgaacgaaagtctagtctagtctgggctaggttaggttaggtgtagaggtaggctagggttagttgtcgatcctttcgatcatttacctttagatcgatccttacagtgtacgaagtacgagtattagtatgtagagagggaataatagatagtaaactgctgcttgctaactgagtagctgactgtatgggatagataggtagggtggtgactaattagccctttttttaaccaacgttgaataacatggaaccaacaattggattggattggactggactgactggacgggacatcatgcataaagaaagtgctagaagaagtgacaagtgcatgggtgcacctactctagcagaacaaccgaacagaacggaatagaacgagcggagaagggaatagaagagaagagaagtggaaaaaaaaatactgtgttaaaaaaaatgaatatagcccgctactcttgactctgttctcgttaggagtaaggataagtcaagtcaagtcagtcgagatgattatgattatgattatggcttgaatagggacgggacagggactaccaattactcgtactccgcactctgcacctccttagtctaccaaaagaaaaaaaatctgactagtgctctaatatactgtgtagatcaatcctagacaggaatcatcaaaacgagacggatgagcgatatactcgacagaaacagagaaaagtagctgggggccgttattagactgtagacgcctgtgcgtggttggtggtggtcactttggttaggtactaagcttggacggcgtacgcggagtatgaccgagtacagagtacagagtactccatacaggctggtataatacgtagacttggatgtagtcgtgttagtcttgtcatatcatcttattattgttattattgctgttttattatcgatgatgcctaatgtttcggatatcagatactaattgcccctattctattcgtttttttttcttcaatttaaaagcatggtttaatgttcattagaaaggagacaatataacagagagacataataagagtgttttaagaaactaattaagtaggagtagttatatatagcggaattacatattactccgtagtgtctgtctgagagtgagctggagctactacccccacaggagcttgagctagcgcaggcgggtcaggcgttatcgagatgttgcctgaaagtggagagctacacccttggcgcaaaacaagggcattccgaaatccgaatcgtctactccgtactccgttactactacgtaggacgttgatcgacgagtactccagacgagtcggagtactccatacaagtactccctgaagtttgtagtatactagtacagccatattcagtacttactccggcatattggccccccgttagtacgagctacgaggaccctggggtctccatggacgaaggatggaccctgcaggatcgggcggtacatagtgctgtgtactccgtacagggctgacagaaattaaccgttagttagcaaccgccactcactctcgagctcggttgatggagcgaatcacgacgagccttgcagtgagacgacgacgtcttgaccaactactcgtacagattacgtaggttgtcgtgggaaatcagaatactccgtactccgtctgtcgggactgccaagacggcatctcgccagcggaggcgattttccccattcgggcaggcacgactgactggttagggctggccggcggcggccgaaaccttaagcagcgtgactgccagatacagactagcgcgccccctcccaacgctcgccccggcggaggcgcacgctgattagatcatttggatgggcggcctgcccaggaaggcaactgctttccggcgggcagatccagccctgcagcggctcgtggccggagaaggccccgtgctccggcacaggcagcaggcaggtccaggcgagattgattagggcagacatggggacgagtacggagtatgtacacgtacggagtacacgtattacagtcacgacgatcagctgtctgctgccctgtttcatagcttgatctattctccacagcgtattcacgccgtactgttagagttacgaagtcaatttcggaagcatgcttcctgctatcctctacgtaatcagggtctgcgccaagtcccgattccgggtcaacgtctccccagatgcagcgcatgcttccaaatcacaaactctgctggcaattaactctggccatcgctcagggtctatggatccggtctgacatgacagccagacttcacgtgtaaaaagtactcgtactgatagtatccctactccgtaccctgctattccatcccactgacgacgctacccgctgcatcctgcggcggaccttcctgcctgccgggacgactagcctcgccaagcccgcgcgcaccaatcagcgcccgcccggctgcattcccgtttgggcaaggccgcatgtgatcctgaggcagcagaagtagtccagagtataatattaatggcagtattatagcccgagtttatagcctgagtttattgggtgttttcagctgcggccggtcaggacccaaatccctgcatagaataccgacaactgaattaatagctacggatgcagtactccgtctatactccgtacgcggcgttgaagtgtatcagaccaagaataggactcgtcgatctcggctagattatcgtagatagaaccatatgaatacactataagccaagctgatcgccacctcgcttgggctctccatgcgtatcctgacattagcttctacagcccgacccgtccatgcggttgcgcttgcagtcagctgatttgttgtaccgtcctccgaaatccgaactgcctggaacctaagctggccccgatcgccatggcgcgccgttattcctgaaccctgcgacgctagggtcctcgcctttggaccctgggccgctggaactgccaaacgtgggcgatccctgctagcggaggcgtctggtaggcaatttccctgaccattggcattggcatgggcattggcattgccgacggcgctgttactctgtctggagtatggtcttgtctgtcatccttctcagcctcatcaatcaatcaatcaatcgaattgtgctcattcctacctaacagccagccccctggctccactgtgtcgtccccagatatggtcttggtcgtcccccggccctgggactcccacgtcgcgtcaagatgcatcatggcaaaagtcaaagagaagcatgatgcctgccctcattactcttcactactctttccgtgcgtttagtgtcgtccctctcggccctgtgacagtatcgtactgattggtttctgactataattttaagtctgccgcttctcctgcattctctggccactcataacgataaataaaaaaaaaagtttaggatacgtcgtcttctctagctgtgtctgtactaccttttctactgttcgacttctacctgtcgagctgtacatcagtggagaacgtgcaacgcactgactcgaactggcatttgtttcaatctgatctcaactgggcgtgcacatctatcgcaattgcaatacggccttgaatagaatcacttgacgtcctacaagaagcatagggttgaattacctcaaccatgtatgtacagtacaagacaatcgctttcttgagtcgaacttatctgactgcatctagtctgcccaaaatgagcagtccaacgagcatactgtccatcttgaacaacgacgataatcctgcctttgctgtgcggaagccgtacagttcagcgtccgcaactccgacaagcacgtataaacatcctcagcagtcttcgtcttacgaacctcgatatgatctcagctcgtcatcactccaatcacagcattcttacaatcaatccatgtcgactgcagtcgctcgatcggccccgtctcagtcgacacagtcaacaacacatgtacatcacaatccagagacaagaatacccccgccttcgtatccatctggcagtgtgacccagcatctccccccacgcaggccctcgattcggagcagtcgagaactggctcctccgatcgagccttcatcaagagtcttatatgccagtccagcggagacgactgcgcctcgagtgactaagaacaaatatccctgtccctacgccgtgtcccacgcgtgcacggccacgttcacgacgtcggggcatgcagcccgccacggcaagaagcacacgggcgaaaagagcgtgcactgtccgatctgcaacaaggcgtttacccgcaaggacaacatgaagcagcatcgacggacccatcgaagccacccgggggaccctgtcccccccgcgggagggggatcgaaagtggcaggcgggcagtgacactgcacagtgagccagccctcaattgcagtcggatacagatgactcctccattcgtgtcgagaagcgggtctacacatagctgttagatctgccaaaaaaaaagtccttgtctagcgagcttgagcttgagcttgaacttgcttaaattcagcagttccgacagcgggttctggcccggatttgttgatgttggatggagtgtcagtgtctggaatgtgctatttcaacaagataaacccccaagcgctgcctcttattttgtgtgataagatacccgatacatactacctactacctactacctacctacctagctatctgacacgggatccgaaacggagctggatagacatgcgattgggcaactgtggcgttatttattggcagggcatggcgtggcatggattcaattagcgatatgcattgttttaaattttgagggttggttctgttgattttatttcatagtcatgttgaaggagcgttcgctagcccaagggattggttcatggatattcttctgtatgtgtatatacgatcaattaggtatttgacaggcaggcgttcaacacgggtcttcctgttatctgtctatgcagcaggagtatgagtacggtagcatgattattatcgactgtctaccaccttcatcaactaatagccagttttatgacagacagaagacagaaagacagcgctttctgcgtcggagactgtccataattacatattttctaattgattaatataatattagattagactgctacattgttagctgtgataataatatctttcagtattattattttatttttgtataaagaaaaataataataaataaaattggcactattattataaatcaaagtaatacgaagtagtatactgtaaataagcaggcctcctttatatctatcaaggtactattgttctattttttttccccctttcgttcaacttctgtaagtttcttttttctctgctgtttatttattgttagaatttatttactcttgttaattaaccctagcttaagatctaaatgaatgctattgttttttttttctaattttttattttataatctaggatcaattattaacagccttactctttccttcagtctatctaaggttaggaagtaaattctggaattgtcgtaagatattattattattatttttgtataataatgactactactcaggcatccgtacctatgtgtgagtttctgtcattaacagcagcaatgtttcctaagtatgctaagatattgattgatatgccgactggatccatggaacactgccctttggttccgttccgaaagccatgtgctccgaaccggaatatgtcaacttactacccagtttggttgtatacacattcttgtaattaattaatattaatacttcaatctttctaccaggataaattcattgccaagatcaatatatttgccctcgttaggctaagaggtttgtggctgagcaagatgacgtcgcgcgatagcccgttattccgttcgaaaggacctcaggtgcaacattggcctagctctagctctagctctagcttgatcgaggcacttagtgctgattccaggctgcatgtttttcatttgatgcctcattcccaggacttgtaaccgttgctacccgacgtttcagctcagccacattattgcccctcctccgctgacccgctgacgatgctgtggaaccgctgcgttttgacctcatcgcgcttcctccactatccacctcactcgcctcgccaagtcgaacgattaagtcgttgactcgttgctcgtcttgtctgcctcaggcgacaagcagccttgcgctggcccaacgacgtcatacacggcgattcgcagctccgcctgtggctcagccttgcgactgagcctcgtacgacgtcatctgatcgctttgtttttatctcttctgtcttcttcccgctttcaagtttgatttcatcagaacgagccgttttgcatcatgtcgtactacagcgatcgccatcgcgccaaacgcgacaggtattcccgcccggcgagctatgtcgacgagacctacggcactgagttggtccgtcgtcagagcgacgactctgtcgaagacgtgtcgcgagattttctgtctggtgattattactacgagtactatcccaaacggagccgggtgaccaccgttcgtcgagctcgctccgtgaatggcccgaatccctactacgacgacgagtactaccggcgcgacgattatcgatcgcggagatctcgacgctacgatgatagacgtgagtaaccatatcccaactgatgtcatctgctcacattcataggcgaccgcgaccgccattcacgctactcgtcctgttcttctcgcagtccgtctcctcgacccaggcgccgtaagtcgctgagcgaacaggccctcagtgcgctgggtggcgttcttggagcctccgcgggcaagcacgacgatcgggatgacgatgactatgaccgggaccatggtagaggccgttctcgcggtcgagagagcttccgtcgtcaccgctcctattcctgctctgtctctcgcagccgcagtcgtgggcgacatgccaaaagagaggaccagatcgcgcaggccgtcaaggcggctctggtggccggggctgcggaggcgttccgggctcgcaaagatcccggcagctggacgggcgagaaggggaagcgggtcctgacggcagccatctcggctggaggcgtcgacgggctcatcgatcgcgatccgaacaagcacggaggccgtcacgttgtcgaatcggtgctcgctggactagcgacgaaccatctcgtcaacggcgggcggtccaagtcgaggtcgcgcaggtcaaactcaagcggaggtgggctcaaagatctcgtcactacggggatcctggccgccgcggggaagcaggtctacgatcgtatgcgctccaagtcgcggggtcaagaccgatcgagctcccgcgacagcgccagcccgccccgtcaccgcgatggtcctaggagacgcagctccagcgtgtccgaatacatcagcaagggactggcagcgctgggattagaggacaagaatgatgacaatcggcgtcatcgccatcgtcgcgagcggtcgtcgcgttactctgacgagtctgacgacgagtaccgggacgaataccggtcatcgcgtcgcaggtcttctcgagatgtacgtggttcccagggcggcagcaagtcgagttcccgttctaccggcagtgattctgacttgggttccagtgacgaagaaaagcgcgagcgcaagaagatgctgcgaaaggagatgctgacgacgggcttggcggcggtggccaccgtccacgcggcacacacggtgatgaaggggctcgaagggcggaaaaaagcgccagcagcagctaaagcaaggccagatcactccggaggaggctcggaaactgcggaccaaggccgatctgatggatgcagcgagcgtggggctcgccgcggtgggcgtcgcgggggcgattggcgagtggaaggaggtgcaggagaagcggcgcgagcatcgagagctcctgcggcgatgtcacgatcgacatgagaggcgaatgcggcgggcgaggagtgcacaagccttgactcggactcagaagaccggctgggaggagtacggatctcgactgcaatataaccgcccatccgactaggctgccttcgatattaaccttgccctatttgcttttgtttttctccacacattcaacctcttcgattttgattcggacgcatttcattttaatacttctttcgcgttgttgtgtttctacatgtattctgtgttaaatccccctttttcctgatcagtttgttcttttttattcacctgatgaagctgacgaagcacctgatgacacaaccccattctgtttgttatgacactattaatgtgatgagatatgacctggactggactgcactaggtgggcaatatgacacgacatgacacgacatgaaatgacggatttggcaaccaagtttgattgattgtttgaatatgttagtctgattaattgctctgtgctgtattctctcgagccttttttttgtttgaataaatgaaataattaattgattaattgaatcctgcatgtgaatgttcaagcttacacagggtttgtttatcccaggtcaattggtatcgtatatggaacagaattgtacagtgcatacatgccaggtatggctttattgccacagatcgagagctcgttagatcaaatggataaataacagtggctattgaccaacagcctacagactaccctcaaaaccccaattatgggctctgcctgcacaggaattaccccgctcactcaactcccccagaatcggattcgcgttggaaccggactggggagaaagattattaggggaatgaatatggggaaagacgacaggacgacagatagcgaaggggggatgttaaaatgttaatttatgtactggcctagagtagaaaaatagtatccattatacgcctctggcagaataatttcgtgtccagacatatctcccacagtatattctcttcgacactattccgactgcgatattctagatcaactacgatatggccacggcaattcccttcccccctcccccctcgtccgatccccatgtctacgtgaccatctcggccctcgaaggcggccatctcacccttccagagaaactgttcgtcacagacgcagacccggacaagcgcagcactgtgccctcgctgtcgtttctgatccagcatccaaacaagcagaatgagaaccagaatcagaatcaaaagagcggtttcgacaagatcgtcttcgacctcggcatcaaacgcgacctatccgcataccaccccgccatgcactcgcacatcgccaaccgccagcccgtgctcaccaggcccgacgtagccgacagcctgcggcagggcggccttgacccagcaagcgacatcgactatgtcatcctcagccacgtccactgggaccacgtcgggacgccgggagattttttgcaagcgacgtttgtcctcggtccgggcacgttgcgcctgctggagcagggcgcgccgccgcattatccgaaggagatttttgattcggggatgctgccgagggagagggtttgggagatgccttgcaccagctctcctggtagcacttcctcgaaggaggatggatacgtgggtgacaaagcgagggcgttccagggtcgtgaatggcggcctctctgcaccagcagcaacgacagcggtaatgagatactattccccgccgtaatcgacctcttcaacgacagcagtctctacctaatcgacagcccagggcatctgtacggccacatgaacctcctcgctcgcatcggccccacgaaatgggtgtatctaggcggcgactgctgccacgacccgcgcatcctgacgggcgagaaggatattgcgctgtatgacgatgggaggggaggtttgcggagtgtgcatgttgatacggatggggcgaggaggacgttggagaggattcgcaggtttacaaataatcagaggggaggtctggatgggtcggttgagattgagattgaggttattgttgcgcatgatgctgtctggagggagaggaatcgtcatcggtttttttccgaagaggttgtaattgtatatttacatagtgtttttgatattaatcctagataagtgtatgtatgttcctgagtgatacatttccctttagggcaactatgtgcagatcagtacagcaccatactccatacattgatcaatagtacagtacactactgacaactctatcttgactatcatcgtctcgacaacttttcttttgttaatcagtacagtagttaacaatgacaacccacagaggtaataatataagttgtggactgtagtacagatgtatcgtatcaataataatacactgttccgttccgtaccgtatttccccgcattttccccaacggtggggtttgccctaactatagatattcatcacctacctaaatcgggtaaaccccaaccccatcgaagatccattgtcggaaatatgacaagcttcctcgcaagtcagcttgattaccgtggagaagatactaatcagttaggtaggaatatttacctcggtcgatattcgagggaatttaatttttctccacgacatagacctagacagtacatgtatctatgtatggatcttctccaacggaatattttgtacagtactttaccttacttgatagtaagatactagctaggtagctagctaggtacataataatgattaatcagtaattaactcgttaacgaccctagtgctagcagcacatatgtaactactgtaagcgactttacttattacggaggaggaaggaaggactgtgggaaaatgaagacttcttacttggtctgacgccaactactacagacctaaagtgggctgacttgacttgatatctgtcttgagcgtaacacgactattgctgttcctttccaactaacgtcccttcttctgctccttctcacagatcattaatagagtgaaagagaacaacggaaatggctactccagacaagacgatcgcgttcataggtatgcagacacttcctctatcctaattagtctacattcgacctatctatctatctgtctgtctgtctgtttgatttgtagataacgtcactaaccattcaggcctcggcgtcatgggctaccccatggccatcaacctacgcaccaagctcgggccagaatacaagcttctgatctgcgacgtcagcagcgacgcactgcacaagttccaggacgagatgcaagaaaagaaaaccggcccggttgaggttgtggcgaatgggtttgaggctgtcaaggcggcggtattaatcaccaaccctcctctctgaaagaaatggtattgttgactgctggggctgtgcgtaggacctcgtcatcaccatgcttcccggtactccggccgttcaggctgtgtatctcgacccgtcgacgggtattcttgctggtgttaaagatgctgctgctgctgctgctgactcgcctcggaggaaaatcatcatggaatgcgggactatcgaaacggctacgattttggaagttgcccgcgcgacgaaagacactgcttccgccctgtcgtcaggatggacgctaacgttcgtcgacgccccggtgtcaggcggaccgatgggggcgcaggcagggacgctgacgttcatggtaggcgtcgacagcgcgagcaacgcaaacaaccacaccttcaacgcagtgaaaagcgtcctgtcgcacatgggcaaagcggaaaacatcttcctctgcggcgaagtcggcgccggcaccgccttcaagatcatcaacaactacctgtccgcaatcacgagcctggcagcgtcagaggcgctcaacatcggcgtcaagatgggtctggacccgaagctgctgacagatgtgatcaacaccagcggggggcagtgctgggtgacgtcgaaaagtaaccctgtgcccggggtgcaggacaacgtgccgtccagccgcaactacgagggcggattccgtatcgagctgtgcaagaaggtcctgggtatggggtcgcagctggctgagatggttggggcgaggaccattcttgacaagcctacgctagcggcgtttgaggaggcggcggctgatccgagatatgctggcaaggacgccagggttgtgtacaagtggttgaatgagtcgagtaggtaggaagatagtaatgttgtcatctattcgagtagtcacaatgatattagtactggttatacttaaacagtgccgaataatctataatcgtatccatatcatatcattattctagtaagaacatatctgatctatctacaagttgatatttctaacaatcaaatgtaaagaaaataaaacacttctcatattgaataatattatcgaaacaatactgctccataaatgctggcccaaaactcaatgcaatgcaatgtaacaaaaacgtcttacttccctcgatgaaatcaatgaaatcaacaatccccaaatgcgggatgaaatgtggggtaattaagcagggttggggttagagtctggggtaaataaacaataaaagtaaaccttactcctacaacaaataatgttaattaattactagcctcgtcagtcagtcgattaataatcgagttaattactctgtacatatgtagtaagctacttcttcgtgcggaggaacatggttgttttaccggttaagctctatatcgattgattaatgatacgatactgcgttgaaaccccgctgatggaatacatgtatgtacagtacatgcatgtacagtattacctcctatatacaaggttaggtagtgtacagtacatacatactaatttggcataatagtcggatttcttgcactgctgctgctactactactgctgctactactgctctataactggagaaggtaataccatacatacatgcaccttgactgcatactgcgccaagccaagtgagtttactagcttgctaatgacaaacacctgactacagcagatctcttgttatgtctgactgactgactgactgaccggactatctggactcgatttatttgacagcttcgaattgaactatatcctgcctacttacacataatattatacctcctcctgtgagaaagacctcccaacgacatatcttaaaagtatgattatcgcagagtatacactgactgagggaattatcggaaatagtaaaccaccatggcatcaacaactgagtcgacgactgcgtcaacgactgccctccccccaacaatgaaagcacaactcctcgacgcctacaacaccccctaccgtctctccacagacgccccccttccaaccctcacctcgccctacgacctgctcatccgcgtcgacgccgcttcctactgccacaccgatttcgtgcttgccgcgggcgagatgcccggcaatccggtctcgttcccgcacgtcggatcccacgagtatgtcggcacggtggtcgcgctgccccaggaccccgattctcccgcagcagcagcgggattccggctcggcgatcgcgttggcgtcggcagtcgcgcgttccatccctgtggggagtgtgatgagtgtctggacgagagtcgtcctgacagcgacggcagaggatactccgtctactgcccgcgcatccgcaccaatggcatcggcatcgacggcgggttccgcgagtatgccgtcgtcgactgcaggcaggtagcccccttgccggacgagatgggcgccgtcgacgccgcgccgctcatgtgcgctggcgtgaccatctacgcggcgctcaagaaagccggactttaccctggccagcgcatcggcatcatcggctgtggcggcggactgggccatctgggtttgcagttcgcaaccaagatgggcctgcgggtgtacggggtcgacaacgccgacagaccactagaactggccagggcactggacaacatcgccggagcgaggatcatcgacgcgcgcgtcgagtcggcgcagagcatcgtcgaggagatcggcgcgcaagacggcaagcagcaccgcggcgagatgggcctcgacgccgtcatcatcctgccggagagccaggcagcgttccagtacggcatcgacatgctgaagaaccatggcaagtgtgtgctggtctcgttcccgcgcaacgggttccgtctgtcggcgtgcgatgtcgtcttccgcgatatctccatcgtgggcagtctcgtcgggagcaataggatcctccgcgagatggtggactttgcggcgaggcatggcattcgtccggttgtcaagaggtttcctctggaaaggttgaatgagttggtgcaggagtataaggctgggtatggggggaagttggttgttgatttcagtatgcaggttgcgtagtgcggaggttgcatttttatcgataggtcagagatagatgggattgacctgcttctgccaacagcatggaggatcgttagggttaggatataggaccgtatgactgtactgttgaggattgtaggcaatacgccatgatatccacgctagctggatctcttacgcatagccagccgctactggctattgcggctgccatctgcatccagcatatcagcgtaaatgttcagcgccgtcccgataatatcgacaatggcccacgtctgcgcgcccttgaagatctgcgcccacacgcgcagcacgcccgcgctcagctgcttcagcgtaccgggcgcctgcagcgagcgctcatcctcgcatttgacgccatactcggtctcgtccagcatcgtcttgaccagccagcagatgcggcgctcgtcctcggacacctcgggctgtgggtccggcagcgccagcgcctccagccacttgcacagcaggaacgcgcactcgagtgagcacagcgagtgctggatcgaccaggtgaaggtttgcgtgcgcgccacgagccggatgccgatcttgacggggatgctgagcgcgtgcgccgagtgcagcactgcccggacgagcttgcgcgtccgccggagccccgttgctgggctctcgcggaacgagtgcgcgatctggatcgggtcgcgcgttgctagggcgtggcccggtcctatgtcgatgttgttcagccggatgtacgccagacgcagcagcgccgtcgagttgaatgccacagggccattggggtccagcgggtcgagcgacgactctgggttctgcttccagcccagctgccagttgcgcagcgcctgttccagcgcgctcatctcgtccgggtcatcttgatgatggctgttgcgacaccgggcgatctgacgcacgaagaaaatgtgctggatcagcgcgtggatgagcacgtagttccccaacgacgagcacgagctgctttccatgccgtcctttctcgctgaccggtcaaacaggcgatggaaggcggtttggaagtcgggctcgggcagatggctccgttttcgagcctcgcgccatctcgccgccgtgggcgccttgaattcggccgcgctgcagggcagcggcaggtggatctccgagctcaggatcagcgacgggatgttgtagacgatgcagtgcaggttgaagaagcagaagacgatgaacttggtccgcttgaccgtctcgtgccggatccactcctcccacgacacgtcgtcgcccagcggttccatcttcagcccgtcctcgcgcaccagcgtggccaggatgctctggatcgccagagcctcgcgcaggatctccttgtgtttggcccaggtggccatggccatcagcaggaacagcgcttgggcggtctgcatgagatcttctgcgggcccgggctcggggggcaggcccaaagggccgggcatggatggacttcgctgtgtagtattattaccctgcgggctggattgcagactcgactctgccagctgagccgcacgcgcgtcccgtcgtcggatccggcgcatggcaatctcctggctgacgtggaagagctcgacgcccttctcaccctcgaagcagtactgcgtgccgacggcggccatggccagcagcagctcgatcgagcagctgcgcaccgacatggtctgcacgtgcaggcacggcatgtgctcgtggaagccgttgatgtagccagccagataccgcgacagggccagccgggacggcagctggaagcccggcggcacgactgaggcaaactcctgcagtttggcggccattaactgtcggtcttcgacggagatgtccgacaacggctttcgcgacgtctgctcgcgctgggacggagactcctccggctgcagcgacggcagacgggagccaaagcgcgaaaaggagctggattcttcggcaaagctgggcgcggggcgatgctgctgttgctgctgttgttgctggttgtccgacgccgactccgggccagggacggcggactcgggcgagaagaacgggatgggctgctcggcgctgatgaaggaggaaaagtggtgcgacgccaggccggtgtctaggaaagccgccagactgtcgagggagtcgccgtccggcagatcgggtcggtcagcaaatggcaatggcacattgacgtcggctggcatatcgcgggtgtctggttcagacgtcatgatgccctgcaaggcagcatgctcagcagccagggacagcgtcgccagaggcatttcattgctatccgtcagcggtgctggatgcgcaggctcgaagctgacaggcggcaggatggcatcctgctcgtcgatgccagcggcctgggcggtcctcttcctgcctcgacgaggtctatcagaataggtctgcgagctcgagtctgtatgagacaggcgctggtggcggatcagcaggtcgctgcgtcgtcagcatggtgtgaggaaaaggatcgataggatcgatagatatgagttacctcctggtgaatcgctgctggcactggcgacagccaaacggcttctcctgcgtgtctagacgggtcagcagtctaatcagccaacgcgggcaattgaatgaattactgacgagtccgttcatggcgctgcagatgctcgagtcgagcaaacagccgctggcagtgctggcactggaagcgcttctgcttctgcttaggtcccgattgggcagaactggcactggggatttcgagcatgctttgaagccaggcaattaatgctgctgagatgccagcgatagtacgtacctactgtaagtctgtaatgagatggttgaattgttgatccggggttcttggcgtggagaagtccggggaacacgtggggtcggctgctctatcttgctctgccagtgttttacaaacatcatcgattagattggtcattgaatcaattgctgtgatattgtccactgttatagctatttctcgtctattctagataataactcgagaatcttaggaactcatattcagcacgattctcccagatatcatatgaataaaagatgagcgtgcttctactagcacttttcccttgccagaatatccctaaacgaaatcgactcctcgtctagactttctctctataattccaccttcttccccagctgccgcacatgttcccccttctccgccatctcatccagcacacgctcagcgaccttcatcgcctccacacccgcagggacacccacatacgtcgtcgcatgcagaatggcctcacggatctcgacctccgtcaacccattgcggatcgcaccccggatatgcaccgccagctccggcgagcggttcagcgccatcagcatgccgatgttgatcaggctgcggtgcttgcggtccagcccgggccgggtccatgcgtacccccagcagaattctgtgatgagttcctggccgggtcgcgagaattcggtcgagccgttggccagggcgcggtcgacgtagtcgtcgccgacgacggcgcggcggactttgaggccttcttcgaagagcgttttgtggaggtcggggtggttggggttggtggacatgtttgacgatcgattcgattgacttgaattgtgtgtgtagtgttattgtagcagcgcaatgtgtgctcttggatgaggtaggtaggtaggtaggtaggtcaatggacagagtgacgaggcagtcctctatgactgtcaagagaattgatcagactcaatctcaagactgtagacaacgagacataccttcaacaaagcgatagaccagccaatttcaatgagtgagcagttgcagtcgcagtcagcagtccagtccgtaaatagttatgtgctgtactatactacggcgatgactccgactgactgacccctcctcggctaccggcaattaattcaagcagacaatccgtcagatggagaatatcagcctggaaggaaatcgaaagtgaaaggtaaagggaaggggaaagagtcggggatgaggcggggtttcgcgtttaccccacatgcgggagatctccgacggacattattcctacggtattacatggtgaataatgatattattaaaaagaaaataaaaaaaatagtagaatcgtaggtggcaaaaatggaagttatgtagcttacaatcctagctaaataacggaaatagctcccaatacaactgtaatttctaattcagatggaatagaatatgtccatgtccatgtctatctgattctatatctatgtactcttcgagaacttcttctcccactcctcatccccgcccagatagcgaaacaccacccgcgaatccagatcccgacatcggggatcattgctggccccctcatacgtcgccagcccggcctcgcccagcacgaggcgcgcctgcacccgcttcgccatctcgaccgccagcccaaagtccttgcgcatcagctgcactttgaacccgtcgcggtagccgtggctggacggcgcttcgggagcgaccccaggcaccgggttgaagcggtcgcagatggtgttctgcgccgtgccggccgcgaagacgcgcgccagcacgcgcgggtccagcccggcgcgcatgcccatgtccatggcctcggagcaggcgatggcgatgatgcccgagaggtagttgttggccagcttggcggccagtcccagcgagggtccgccgcaggggatgatctggcggcccatggtttccagcagcgccgtcacgcgcgccaggttggggtcgtcgtccgcgcagcctaggaagaaggcgatgctgccttttttggctccgatcacgccgccactgacgggggcgtcgtagaaggacgctgtcggacacgtctgcgcgatctgctccttgacgagcaggctggtggccgtgtcgatggtcgagcagtcgatgagcagtttgttcgtcaggtccgtcgcgcagatgcctgtctgcgggtcgagatagacggtgcggacgtgcgagccttcggggaccatggtgaagacgacctcctagacatgcagttagatatgaccgtcttatcatgctaaacgcttctgacgtaccgatttctccgcaacgtccctggcgctggacgccggaaacagtctgcccgggtgctgcgcgcagagctcatcgaccacgcgttggacgacgtcaaagacatagatagaaactccggccgggagtttggcagcgagatggccgaccatgggggcgcccatggccccgaggccgatgaagcccacggcgcggtagtcttgcatggatatgtgagtgtagtagagaagtaatagatagaatataattaaaataaatagaagtgtatttatttctacaagtcgataacaaagttgaatcgtaaaggaccgaggtaacgtcgagaagagtgcatgctaaagttagcacctacccagataggcaattacccacggacggtactgcggagtggtacggtacagtacgatacactacaaagagttggggtaaatcgcatgcacagatcagacaatattctctcaatgacagattgcagacgaatgacgtgtttagagtagattaaattctccggaaagttatatgtctttttttttctttcaaaaaaaaagaaacgaaatggaatggaatcacctgtaatgcatgacacagtcagtaccgaaacgtggggtaactctattgtaacagtacagtacagaacaaacacccccgatatggaaatagtccagtccactccatgagcatcccggattaatcccaccacaaggtatatgtacatacatatctggttctccagaagaaataggacaacgacgatctatcactaaaagaaatagctagctagtgtgaaggtaacatgggataggtggtagattaacagatgaattaaactgccttgataatttaccacctcgtgtatcctacgattgtactcacgtgcatcctacgatcatactctcgtatactgtatatcttctcacccctgatagcagtgcttcgcaaaacacgccgtgcactccgacggcaacgcattccccgtcttcgccatgatcgcacatcccagacatgtcccccatccagcctcgccgttctggttggccatcgccaccccgttcccgatcatcccctccgtctcgctggccgaatactgcaccttggttgtcggcgtgttgctcgggtacgtgaggttgacattcgggatgtacacaatcgtaagcttgtccgtctcgttgcacccaaagaaggtcgcccgcttgttcagcccctgcgagatgaacgtgtcgaccgacgggatggacggcatgcgcgtcaggttgtggttgaagctctgcacgtacgtcgtcaggatctccgacccgttcgggaagttgttcgcgtccgcgctgttgtcgttgaccagcaacacatccaccccgcgcgccggctgcagaaacggccagatggggttgttctgcatcgcctcgccgccgtcaacgagcctcagctccgtttgctcccagatgggattcgccgggttgggcacgccgctggacgagttgtagttgtagaacgggttcgggtagacggcgaattcatcgcgcgtcgtcagcgagtgcgtctgcacgaccatctcggccaggtcctgagttaggttcgtggtgctgttggcggcgatcggtatattggggcaagcctcgttgaagaggctggacgacgtgccaaggacatatccgagattgtcgtagttgaccacacagtcgccggccttggtaggctgcccattggacagagaggtgcccaggtattccgtcggcgtaaaagcgctgatgtcgctgtcccacgacccaaattcatagggcgtgaattcgtaggtcgtcgcgttggggcccggccaacactcgccattgaaggtcttcacgcccagcgcaaggatgatgggaaacggggccgcatggctggtgaagttggagaggctcgcgaccgacgagaaggtcgtgttgacgccgccctccggggcttccaaaatctgatacgagagcagacgaccccatggatcggtcagggtcggaggatatccagccgcttgtttggccgtgatatcagcaaggacttctccatattctggagaagcgagagggttgctcgggacgagaaggctgttttggaacgcttgctcccagaggccctctttgagagccgtgacggtcggccagttgttgccagccagggacgagaggagccaggcaccgcccgagagaccggagtggtaggtaagggcctgatagagcccactggtggagatgttgctgttccgttcgtcaaggccttggatgagcccggcaccgaccagcagagaccggtagcctccaccgctggtggccaatgccagctggaagaagtcagcgaatgacctggaaggattggaaaggcgagcttaccgtcggcaggatgctgtcagtatactgaaacccggggtttgtcttggcgagccatgacttcaaagcctggtcggccacttgctttctcgcttggcggaacgatgcttcgtcggtactcaggccgttggccggtctgaccaggggggttgtagggcatgatgtgtggactggcgcgtagccagcatcaacatgggtgagcaggagggccgcgagcaagaggccgtgggcacgcatcttgatgaggaacgacctggacggtggtcatcgtttaccaccgccacccacggtttccagcaatatataagcatcgtggccggcccaggccaagcctttgaagactatcggtctcatcatttcagtaaacagtccgaaatgaagatgggcttggccggagtaaacagcgtgccttgctctatgcaggccagtgtccgtctgtcgagcgctcccacgtggtagcaggatgatgaagcaggtgggcatttaggcagaggtccaagcatattatcatctcatacaagaggcccatgcgagagcaatcgggaggacgccgtcggaagtggttcgagatgggattggctggtgctgccacgtgagcggatcttgcatgcagcgttctgtagatcgatcagagcatgccctagccttcgagaattgacgatttctcagttgatttatcgcactgcatgaaaacaaatgtgcaggccatgcagtcaaggcatcaaattttgtgcaaccgaccaagattgaaatgaaagattgaattggataagatgaaggatacgaagaatgtgaaggatgtgaaggatgttaattatggcaagtgcacgcagctccctgcctgatatggaaggtgcacaggaacagcatactagtcctaaacaggtatagtccgcgctgcaggcccgtgacatccgctgtcttggcattattcaacctctgcattgagggattcccaggaggcaatctgaccgattggactggtcgaaatcacttccggacagattttcaacagaaaagacttggaaattcagaaataaagatttgttcgactatttcgactagggcaagtgtgatggatttgtgtacttctctaattggcgagttgatcacgtgaagattagataagacggcccgtgaccgcgctagctggacgggccgagcgacgtcatcgctgcgatgtccaacctcactaggaactcctttgactatttctacacagacaggctgctggatattttcttttaattgcttcgccaattgcgtcagtcatggcgacgttgtcacggaccgtgtctcgatcgtctcagattcgagccttgagagaggggatgatggccccttcagtatcacgtcggttattaccgcgtgcagcggtgcaattcgcgcgaggatacacagcacaagcatccctacacagataccgatactggcgcagacagggctatccgacaccaacctcactgtcgcctgcctggacctcccgacgaggctacgcagatctgaagccgacgtccggcaaaagcgaggcagatctgctggtggaggagctgcaggagctgtacgacttgccgcttcacataagacgagttacctgctgattgctggatagatacgacaacgccaaagacgagttcgaaatcgcgaccgagagcaccgacgccgccaccatctacgccgcgtctgaccgcgagtcggcccgcgacgcgctcaaccatctgacccgcgtgtacacgctgtacacggagatgacgacgtcgtcggcgccggacacgccggccaaggtgcccgagggcgaggtcgccccggttccgaaagaacccgtggcacagaacccggcggaggccatcgcccagggccggacggaccccttgctctcgggtgatccggccgcggggccgcccatgcagggccaagctgagggagtggtgggtattgcgcccaactacaacccagaggagatcaagccggaggtgcgagaagaggtcaagcgacgggtgggacagcggatccgcgagctgcagaatgcggttgcggcgttggaggagcgggcgcgttcgcaggggtgatctatctacatcaggaactgatgacattgaaatcgcaaaacatgatatagaagatgtcttattcagtcgtaactatatataacatactgtacaactccatcggcagagacaagaaacaagacagcaaacatccacccagcaagcaatagacatatatagaatactaaaactgataccgaaaatccggcgcccgatcactccattcttcagggggaatcgtcttccccaggaggatatttcgatccttccccctctccctacgccagtagataaacaggacgatccaccatccacaccatgcgaaaaccaaacagcccaaactccacgagtggcccaacacaaacgccggcgcggcagccgtctggtagatctgccccgctacaacaccgccgatattcgtcagcgagagcaagatgcccacgctggcggcgcgtttcccgtcaggggcgcagttggacgagagccaggcgatgttggtgcctgtgcagaggtagcatgctgtggcgatgaggtaggtagcgaagtagcgcacgccaggggatacggcgtggtcatggccgttcacgaccaggatggcgtacccggcgataccgaagggcgcggcaaggatgagagacaggaagcgcgctttgtagcggtcggagagtacggcgccgacggcgtaggtgagggcgccccagaggttgacttggagagttagcacagcaatattgatggatggagatgggggatagctatacgtctacgtacctgggataacgagatactgggcctggatcgtcgaatagtggaatccatccttgaggatgatggggaggaaggtgccgaatcctgaagtcatcctcgttagtctagtagtcttaaataccatcaacatggttattaatatcaaccaggttgatgcacccgaaggcaaggtaagcccaccgtaaagaatcgtcacgacacagatctgaatcacgccatgaacccagctcttgacatctacagcagccatcttgatatccttccatttgtagtgtccgcgcccaccgctgtacgaggccatgacctccgcgcgccggcgcatgacgaccttgtccttctcggacaggaagtatgctgtctcgaagttcttgggcacgacgaacaggcagatagctgcccagacgatggtgatgaggccttcgatgatgtagagcctgaagtcaccatcatcagtatgcagtacagcatgcaatatagtcatagtataggtatgggtatagaacataccacctccacccatgcaaccccgctgtgccatccatgtagagaatcgcataggcaagaagaccgccaaacgcacctgaaagagcggatgccactggtatcgtcagcatcataaacacaaacaacacaattcagaagatcgatcagaaatcaaaaaagaatagaccggaggttagtgttagggttagggttgggttaggcaagaccaaccaaaaagaaacgaaatcctcgtcgccaactcctcgcgcttgtaccagtcgcacaggaacagtgtcatagacgggaacagacacccttcaaagaaacccagcagcagacgcgtcacgacgagggacgcaaacccctgcacgaagccggtgcacaggcagacgaggccccagcatgccgtgatgaacgggatgacgcggttgtactggaggcgtttgacgaggagggaggtggggaactatcatataataccagtcagtcggtatagacaggaggatattgtagtaagagaacgggtacggaggtgcatacctcagcaaggatgtagaagacgtagaagacggatatggcgatctagacacacagcggtgtaaatgcgtcagtcaaatcaagtaaaaagagaggtccgatcagcaaggatatactgacattcaactccgacccctttaacccaatatcctttgacaagccctgcgtcgcagcgaagccgatctgcatgaaccagacagcattagccaagaacagcagcagagaagatccagcatgtccctggaatatggtattgcacgcacattcccccgatccagatacgaaatcagcatcagcagcatcatgaccggcgcaatgaagcagtcgagcttgaagacgacggccgcttcgcgtttgccaaagtcgtcgtcatcaatatcttccggatggccggcatcacgggtcgaggagacggaggaattgttggcatcctcgatgtgcagcccagtatggggtttgtcgttgtcgagggaattggaattgagattgttgtccatggtgataaaaatgatgtctatacagaacaatgaggtaggtagataggtaagtaggtagggataaggtagggtattgcaagagcaatcctagcgatgatacaagaactatataatatagtatctgtgctgttcttatagttttcctgcgattgtggataatagtgcaggcatctacctaggtagcagacacacttcggtagatgagatagtatgtgcctggtcttggttagattggggtaagctactcgtaatcattacaatctaccattgatttttacgaatactactgattcagtagacttgacggaatctttccgtggattcgtaatatctattggagcaggtctttaatcgatacgagtgaagtaaagggagagacagcaaggcaactaattcgaatgaatgcttcattttctttctaaaccttgtcctgtctacctgtctgtctccaaatgaatggtcaaagtcgacttcctttttgtctccccttttctctgtcttccagttaagatatctatctaacgacctaagtacatacatggagcttggtatttccccagatgcatgtttttgcggggagatgtggggaaatatggctatctgtcggacaaatgccgaaagtcggggtatatccggatttaccccaatttgtggggaaggcactaaatctggggaagtagtctggagaagtagggctggattgatacgctcatattactcgtattgtatgtaaagtacagtacatgctgggctacctggcagccacctccctctcgacaatcggcatcgccaccgtcgccgtgtgcagactcaacgccgtcgcaatctccagcacctccatgatctcctccggcgtggcgccgtaccgcagcgcattgcgcatgtgctgcttcagcccgggctggtaaagatgcgtggcagcggcgtcgaaggcgcagtagatgagttctttgacctgcactcgtcaggatgtattctgttaatagactgatgcagatgctaccttcggctccaacacccccttcgtaccattttctggcctccgcacccacggcaccgacgaaaactccaaatacgcctcgaaaaagtccgggtccagccgcaaaatgtcctcccagaaggcgtgccagtagccgcggttttgcttaaagtcggctctgagctgttcgcgtcgcgcgtctagctgttgcgcttctgcagctggatggccttcttctttcaatacctcgaccagcagcggcacgccaatgttgcacgcgtgtatgcccagcgtgctggtcagctcgatcacctcgacgagttctgtcgctgtggcgcctgcagccagcgcggcgcgtacatgctcctcgatgcccgggacgtgcagatgggtggcggcgctatcgacagccaggccgatgaaggcctgtactttgggcgagagatggccatgtcgtttggggacgctgcgcagcgccaggctggcttggaagagttctgggctgaggttcagcacgctctgccagccgtcgttccaggcgtgagggcccagttcggcgatgaaatgctgcttgggaggggaggacatggcagttgtagagttgtgaagaaaaagataattttgctgataggaagattagcaacagtcacaaaatagataagtatatagaacaatgttatatacctgtgacatcgtattggagttatcagtggggtatccccacctgcacagtaacaatacgattgataagtattccattcttgttgtattggtatgaaatagctaatcgggctgtttacgaacaatcctcctaactatgccaatcttcagtatatgctgtactgtcaaccgtagatacgacatctacctctacaaccgtagatactatctgccgtgtcattcctgtagcaataattcctccaatcaacagcagtaatcaactactaccgaaaaaccgactcttattcctcgcatcgtcctcccactccacatcatgcgcaaaaatcacttctacgccctgctcctccaaccccctgatccgctcgatcgtctgctcagccatcttccgatcagcgtggatgcagcagacgcggccgtcgtcgtccacccactcgccaatctctctctcccggcgcacaatccgtcggtcatggcaggcgtcgccagcgagatacacccagtttgttggttccggtccggttttgacgagcaggttgatgtgtcctggaagatgcccgggcgcatggacgatatacaccgtgccgtcatgaaacaagtcgatggaaggaagattgaacggattcgttgtccagggctgatggaagtctggcccagaagtttccttatcactagcccggtcgactttgctgctgctgtcgggatcgctcagctcgatcgtcctctcctccggtagcagatcgggctcgaagaaggagtggctgcccgtcaatgaccggttcgttccccggaggagatccctcgcgccagggccgatgacaaacgtgctggtgggaaagtcgcgcggctcgccgacgtggtcccagtggacctggaaatcaagatcagacatgaaccaagcagacagactgtaaaggactgcatacatgagaatacaccacatagtcgatattccccggcgtcagaccgcctctagccaagctcttgaccacatccgggtctgtcgacagcggctggcgcgtttccgcatgcttctggatgggcaccgcgtacagttggatgtctctcctcaggcccaggtcgaagacgaggcgggtgagttttcctgtggtcggatggcggtgctggatgaggaaggccagcgatggcactgtccggcgagcggtggcggatgcgggatgcacaaagtacttttctggcagggtgagatggccggcggagagggcgtgcaggtggacagcgggagatttgagggagagtgtctggttgagggtgatggttgacatggtggttgtcacgttgtggaagtgaggatatgggtatattgcaactgataggtatattatcgacacatttgtctactggtataaattatgtctgtaccaatctgatgtctaatcgcctgtctgccttgtctaatggcaatgattatgctatgtgggggaatactctatcctattctgtacaactgtatggatatgtatttcattacattacagaacaatacactgtcatgatgatcatgtgattgaaaattaaaacgaacaccatccagtccagatatgtagattggacagtgatcccagtggttagggttaggaatgaagagtattgtcttctttcttaaaatgtaatcttacgatgtaggtaaataaatataacagtagatcgtaaagacgtatggctctgttctacaaaaaaaaaaaaaagaaaggaaaagaaaagaactgattgtttcaccctaagcgttgtggttggatttttatatttaaagaaatggtctgtttgtagaaaatggatgcaccgccacttcttttccttgatattataccctatcgctaaccattcctctaatctgagaattttcagttattaatatcatctatttattcttatcaagtaatataaataggtatctattatctcctctaactacatcttctcatcagtattcattcagaatcatacagacactggtatcgtctctttttgctgttcagaaactgtttgtagggaatagatagtagaaagtatgtacaaacatctcgatttccgtatttgcaaataaattatgcagtcaataattaggcacgtagatagataatagggtatacacagacctaagacagacaatatctttactccagtcgatcgatcaatcgaagaagaacctgaagatgaagatggagatcccaatcaatctttagaattgaagaatccagtgttctagaaaggaggaaagagtcctggacacccgaagactcactcaaattgtgacgaaggaagatttgataatccagacttcgttaaagagacatggctaccattgttgtagcaaggcaatggcgtgttcattcagtagtatagaagatgcttcagactccatacatacatgtatggaccatccatgtgaatggccttaagatgaaggaaggaaccatgagattgaggtctgagtacctactctgtatggactgtccatacatacggtccaacaatgggtttgttttgtcgtgttgttcacgacaagcggtgtgcagtgccctgcagatcaccctctacagtagattaaagcttatataaaactagtctgtataactaacctactccgcatactccgcataaatctccatcttggactggacaaaaacttcgaacatcgggcttcgaaagtcgtctctcctcatcagaatccagacagactattttatctcgctacagctgaaccgtacctcgtaacattagctactcctaattaggtaccttagctagccaagactactacctattgataaattaggtggtggtggcgcgctgaatacgttatctaagtaagtaactaggtaactaatgatatgcaatgatctgcaaggaggagatccatccacgcttccttcgatgattggtcaaaataaggtcaataaatacatgtatggagtaaggcgatcgatcgatcgaccatgataataagcataagaggaggagaggagagcagattgttgaagaatgtattgctcttataagttgtacagtacaataaataaaaaaaaatgtaaatattatcttccacggtacatactgtatgcacttagtatatctagcatctagcatctagtattaattcaccctttactccgtatagtgaacttaggcctagagtactccttactccaccccatacatacagactatacagctcatgcatgctcagaaccatatatacatattccagcaagtagtcgagacccactcgagctgaagatgaagattctcaaaatgcttcttgtttcagctaatgagggtgcggagtacctatacttctatatgaatatgtatgattgcatattctttgtctataaatacaatactatataatataaaataagtcaagggctggtacttctcttactggccaaagtacatatatatcatcccaccatgggcatagcacttacctggcaacatatcactacatatctccttctatacctactttcaaacctccccgccgtcatcgtcgcagtccacgtccacatccacgacgagtccttcacccccgacatcgtcctgcggataacagcagagaactacacccaagcatgccacgaccgctactctgttctgatcaatgggtcctctccgggaccagagctgagactgcaagaaggccggaccacgtggataagggtgcacaatgatatggaggttgagaacgttactatggtagtatcctatcctacctatcctcatatattagtatatctgcattgctaattttcttttctcgactacgctagcactggcatggcctcagcatggtggtcgcccccttctctgacggcacacccctcgcctcgcaatggcctattcctccggggtacttcttcgactacgaagtccgtccggacgttggctacgcggggacgtatttctatcactcgcgtgttggctttcaggctgtctctgctgcgggcgcgctgattgtcgacgaagccgctccttcttctccggcaccctactcgtacgatgaagagaggatcattgctcttggcgatttctttcacaggacggatcgtgatattgaggaggggcttacggggaaaaacttcacttggagtggtgagccggatgcgctgcttgttaatggtcagggtttaccgatcagcagcagcagcagcaacagaggtggcggcagctcctgctccatggcggccatcgacgtcgagcccggcaagacgtatcgtctgcgcttcatcggtagtacggccctctcgttcctgcgcctggagatcgagggccacgagatggagattatcgaagcagacggccagtacacccagccagtgcctaccagctacatccagatcggcagcgggcagcgattcagcgcgctgcttcgcacaaagaccgaaagcgagctggcccagagcaagggccagggcaagggatacttttatatccagctcgtgacgctcgaccgtcctgccgttcgcaccgcgtacgccgttctgcggtatcccggtgcagacgttgatctcatgacggccccgagcacgcctcctctgcccgtcgcgtcgacgacgaacggatggctggacgaccagctgcgtccgctgtgtccggcgccagacttcccgtctctgtcggagatcacgcggcggatcgtcatcaacgtgcatcagaccgtcagcgagggcatcgtctgggtcgagaacggatacccctggaccgagaatgtccccaagtcgccgtacctgatcgacatctactccggccgatacgacctggacgcagcgtacgagcgcgccctggccaacggcggcttcgacgccgtcacgcgcacgttcccggccaagatgggcgaggtgctggagatcgtgtggcagaaccagggctcgacgacgagcggcaacgtcgagacgcacccgatccacgcgcacgggcggcatttcttcgacctcggcggcggagagggcacgtacgaccctgtcgccaacgaggcgcggctgaatggcagctcgcccatgcagcgcgacacgacgatgctgtaccggtaccgcgagaagacgacgccggggggcaacgcgagctggcgggcgtggcggctgcgggtcgacgacgccggagtgtggatgatgcactgccacatcctgcagcatatgatcatgggcatgcagacggtgtttgtctttggcgacagggagcagatcgtgcgacagacgggcacggcttcgtatggctatctgacttttggcgggccggcctatggcaacagctcgcactggcccgaggtgatgcatttttttgactagaagagtctcgtgatagaaggacgataaatcttgtccatgtatctaatgaaaggtgttgttaagacagtgtgaagcaaattaggcttgtaaataccattcccttccaaagtcaattcattcaacgacgtgagaggacatttcatcatgacatatcaatggtacaatctgtactctgtcagaaactaggtcatcataactcgtaggaaaatggtttagcatggtataatagcaacaacctaagtccatcctgcagtctaatcaacttcaatcaaacatcgatgtcccttaggagccatcaaaaagaaaatcttctgcttcatgtcatcctcgctcatcccctccttagcggatattctggcattggggaaggctcgaaagaagaatgcggcgcccagacgcagttcgattcgcgcgagatgcattcccaggcagactgttaaattcgttttgttagaatgtctcctataagatgtacctggcggtaatatttaggtaatgcttactgcgggaaccagccccaaacggcatgaaggcgtgtctcatctccatggtcggggaagcccatcgcgaagggtcgaatctgataaaatcagcttaggtttatggtctagaaggtggaatgatcaaaaactgaaagaaatataatgtgaagagagttctcacttctccggctctggaaagatcgtctggtcgcgatggaaactataagcctgggtcgacaccgtcactccgcccgggagttgatatcccgccaaatgagccccttcaggaggaacctcgcgaggcaaagcagccggaattgcagaatacaagcggagggtctcgttgatgacctgctcgagatagggcagctctcgggcatctttctccgtgaagccctccgggagagatgcgacctcgtcgacgagtcgatttctgatcttctcatcgcgacacacggaatacaccaggtaggtcaacgtcacggccgtggtgtcgctgccggcgacgatatagccctgcgcctcgtctctgatctctgggtctgacaacccctcctctcccgcatcgaacagcttcgtcagcagagtcggtttcggatcaacagcgagcatcttccgataccgcgccatggactgctcactatagctggcgagtctccatccggcctctgcggctctgcggaatatagggatgggcacaaactcggagagtttgacgaggaatggaaaggttgttcggattggttgcaaggagatgaccgattccagatctaagacgtactggtttttctacacaggtcagcaggagcagagcggcataaggtgatattacaaaccttgccgtattctaccatgcgaaatgactcgccaaagctcaactcgccaatgacatcagtcgtcataaatgtccaccacttgaacacatccgccgcaccgcgaatcttcgattcttcctccatcctggagatggtcaagcggattcgatcagtaatgagaggctcaaagtgcttcagagacgcgtcagccatcggggccgataggatacgacggcgaagagcgtggaatttgtagtcggtagtgctgaagacgttctccacgccccgcggtataagttttttgtaccactccgacttcaagaaccgccctccaaccttgtggatctccctcgctgcgtcgatgtcgcagatgtgcacctcatcggggctgacacggacgattggtcctgggcatactcagctatcattctctctggatgagactgtactgaccgtatttttgatggagagagtggacgtaggtagatcttttgccaatgagccagtagtaagtaacaaccagacctgtccacttggagtgttgaggtccaggaatggcggagagagggcgattgaacggtcgaaagtgcttttcttcgtcagaaggcagcttaggagaattggatctcacttaccaacagaacaaaagcaacgaggcagccgaacaggatgaccggcgagaggtattcgaagaacgaatccatgcttgcgtagcgtagttggtttgatgttgcacattacattcaattcaattttgttctgttcaggagccgtgtccaacatgaattatatattgaaaacatgtcactgaaggcgactaatcggtgcaatttctcggcacgatcaattcatttcccgactgacgcagaaaaacaattgctgtaaaatgctccgtacatccaacggccggagaaaagaaacggactttcggccgtttctcgcgcgggatcgcccagttccgacgccgacgtaggtagatcatcggcccactgcgtaatatatttgcggggtagataaaaaagacgtccagtccagattcaaagacgtgatattttgctcgatggctggatggaaaagagccggggtccattgttacatggactgactgcatggacggaccagcggaactgcaactgatttgagctgtcaaaaaaaagccctgcttctggaccaggtttgatatcatcgacggagcctatcattgcgataaaaaaagcgacaggggtactcatgtcaatattgataatggcgctgtctttggccgtcactcgcatgaaaatagggccggcgaactccaatcgctagtttatatcggcatccgataagcccgacaccgatggaagatgcagaccagactcagagacggcagggcaataaataatcctgattctcgaggatacctcatgaagggtatgtctgacaaggtagcataatattgttgtttgcagaacaaagaggaaagacaggtgtgtaagagtgaggttcaaaagattggaagtagcacatagaagcactcatatacgctagtcctgattagggcacaacccataggacttggaagagaatcaagacatcaaccactgcaccatatgcactttttctgttgtgtttataggcaagtacactgaaagatggaggacgatgaaattccctaaaaggcaataaaaaaaagaaaaggaaaaaaaaagcttctgataaggggtgccgtccctcccgcagcacccccacggatcttgttaggtaactgggattttcatgtttttagaacccagagggatcgaacgcggggtgtttttgtttttttttttttgcttgacagtctgtttaccagtcctgctgcaggtgcagacctaaccgctccaccattttaccccccgcgttcgttgccaggaagagaaacaaaggattgatatctgcccctcagagtatgatgtgattggttgagctggctgcgctgggctgggctggtgactgcagtggtaagaagaacttttccactagttgaggagagttctagctcctagcttccagtctggccacgattcatttacatctatctcgtctgcgttgatagcacattgtatgtgctgtaatgaagtgacccatcatgactcgtgattcatatcatgctacatgctacatacatgttactacgcaaatgcggggagcagatggcttcgttgcggccgtcacgtggatgcatcaccacccactccaaaacgccttcagcttcggcgccatgtcgttggccatcagcttgtggaaggccgatgtgggatgataggcgttccaccagacacatccctctccaatgcaggtggcattctggaagccatagtcctgaggattatccaggacttttgtcataaagtcccacgcgtcgtataggacgacagtcacctatgtgaaatgagtctgtgttctattccaggaccgtattattacttacgtcagaattggtttccttgaaaatttcggtcctgagtgtcaattccagattgtacgtgctgacatacgcggcatgggcgtctgtcgagcctcgcgacacgatcaatggcgatttcgttgttggcggaacggtgagaaacaaaaactgtcgagcacctttttcatacacctgctggacaagatcgaaatagctatccaataggagcggcactgttgtatcaggatccacagtttggtaggaatgtccaatgctgcaggttggactgatcagaaaacgtcatccgcctgtgagcacatactcactcgttaatcccgatccaaaatgcaaagacggcgttttcagccgtccacggagtcgaggcaggcttctccgcatagttgggctcgaaggtcgattccacctgtgagactaggtcgcggacgggcgccttgacgatggaattgttgatgcaggcgccgctgacagccagatcgtagttgagcacgagactggcgttgaagacggtggtgagatagccgacccaattgattcctccagaggatgtcccctggcctggataacggttagaaaacaggtatctcagggacggtctggacatgcttaccaagaggcggattgcccattgggttcgtggcagaaggctgcgtgagcagcggatcgaagccagtggaggtgtacgagttaccactgcagagtcaggtcagagtcatagtactttaggggtaaacgtacaacgtgaagaagaatgtctggtcactgcggacctcgagtggagcggcgtatgtcagcctggtggctgataggatagacacgaggacgtaaatcgactgcatgatggaattcatgtcgaatatgagttgaatactgaagatcgaatcagttagatgagagtttaggaagtactgagcgagttagagactcgggggtttaaagggaaacagacctgctgaagagtcatccaagggcaatcagccttgtgacacaggtccgttcatccggtggcacgagaattctacaggtttcaagtccagtctacatacggatacgtttaagatattccatccatgtcactgtgtaaggagaaagttggttaacgaagaacattctggttgagtcaattcttgtgtttccggtgattctgcatttccaaaaacggaggcatcagggactgtcacccgcccagtcatcgctatccgaatccggcaggagcaaaactgagaatgaatcacgtgtctacaatcaattatgacataatcctaatataattctaataacgtaatctataacctagtcggacaaatgacctagtcggacacttctcaccacgcttacgcgcctccactcccatcaacaaaaatgcctacctcaagactcccacaagcttccaatcaggaaggaaagattcttttggctcttcaagcatataagaagggccaagtctcaagtctgcgaaaagcttctgtgttatatgatgttccccattccacattacacgatcgattgaaaggccgtacgacgcgagagcatgcgcaggaaaggaatcgaaaactgtctgttactgaagaaataactcttacccagtggatactatccatggatgagcgaggaaagcccccccgagttgcaaccgtacgagaaatggcaaatgtccttcttgccaaacgcgatgaatccactactccaccctcaatcaagcacgatccggctaacagtcggttctttcgcacgtttagtacactgcttccgccaagacttcgtctctggagcaggtctccaaggctctcgcccagctgggtgaggtcttcaagaaggacgccaagctgacctccatcctcaacgccccgaccctctccgccagcgacaagcagcagatcgtgcaggagctccacaagattgccggcgccgacaagggcgacattgtgaagaacttcctcaacaccctggctgagaacaaccgtctgggcctgttggagggcgttgtcgagaagtttgcgactctgatgagcgcgcaccgtggtgagatcgagctcagcattaccagcgctcaggtgggtgaatcacgtcaatcactctggggagagcaacttggatttccggctaatgagtgtggaattgcaggaactcgacaacaagaccatccagcgcattgagaaggctgtggccaagtctgagtacagccagggcaagaagctcaaggtggtgaccaaggtgggttattccatcccctgctactgttatacagagtggtataaactctgctaaccttcccaggttaaccccgacatcattggaggcctcattgtcgagattggcgaccgcaccatcgacctcagcgtttcgtccaagatcagccgactcaacaaggctctgactgacgctctgtaaaaattaagttgccctacaaaccctttccttgtcatccgcatgatgtatccaattgtgtactaggtttctagatttttctttctctatacagttccaatttcctttgtcatagcatagtcttgagaacccccagaaaaggaaaatcggaaactagatttacagccagccagccattgttctcgtcgacatcagctgcagctgcaggttgcagccagtaattgccagttttgtaacctgcgcctgcgccctagtcattaatgactaacggacagacaaggaggggagagaattgtagatagatagtcagctatatgcagacatatggactgtatgtatgtatgtatgtacgtgctgtacatgtatgtatgttgtacatacgtcatgaaaactagttagttcactagttcattgataaggtatattacttacctaggtaggtaggtaggtaggtaatttcggggcttttctccctctcactctcttttcttgcttctgttctcattcaacatttgaagaaaggggcaagtaaattgaattaaatattcattgaaaaaaaaagatatctatggctttacggctatggctctactctataatctattctacatatttatttattaattaatctggtctagaatattccgaactgatgtatcactaacatttctaatatataggattaatactgcacatacttacccacttggcagcaatgatcatcatcatttcttcgaatataaatcattttattattattattattatattatgtccagtgtagacaattgactattgttccgccgattggtttgctccggcaggggaattgggactgactgcatatcgttcataattaaaaaaaaacggaagggtctcctgtcctttgcttatactttactaacattactgactagataccagctaaatatgaatcaaatgagaatcggttccaacaatgtgttaatcgtaagccctacggagtacatgcgttatacatacgtgcattcttactgactcgccttattattttccggcagaaaatgcagcggcacaggcttcccccagaaatcgcacggattgaaccgccaggcgcccttgttataagccccgaaccagtacttgatcacgtacggcagaacccccggcaaaggtgggaagttgttgcctccttcgtaggtcttgtcgcatgttcctagcacgcaggggaagacgtcgtactataataaatcagtatcacttcgaatggtctttttttttggcaaggtacgataccagcaaactgatgttccccgtcgccttggccacctgctcggccttatcacagcaggcccgcagcccgtcgctgtcgaactcgcctagagacagaaacacatcaatctcctcgtacagatgtctcgtcaggctaggcgcgaatgcatcgatgatgctcttcattcctcctcccttgccgtcttcttcttcccaccggtactcttcaggcttagtctcctgcgcataccgcagcagccgctccaagcccgacttgaactcctcatgctggcccttcggcccatccagcagccccggccgccccgtaaaggcctcgatctcagggaacatgcacgtctcttccgtgtggtggtggtgttccaccgtcttgacccacgccgcgacgtagaacagcaggtcgcgcacgtcctgctccgagtaccccagggatcccgctggcgagatgtgcggcgcttgaaggatgatggagttgaggccccggaggagacagttgtgtgagtaggccatttcggaggctaggtagatgtaggaatgggagttctattaacgcatgttagtatacacacaggcaggttcggacagtatgtaggaaggattggagaactttaaagggattattattgacatacaatatccaacgtcttggaaggcgtaggaatgagcttgaagggctcatctgcccatggggctgctgacggtttggtggtcatgtttgtgttgccagcacctcagtcagagaataagattatgtttctatatagattctcctgacaaaggggtatcgtatttttaaaagaatgcttaacgttaacgtcaacagcatccatgacgagtcacgacctcgacattcattgaacagctgactgggtgcgtggcctgcgtcagataacaagaaaagcaactaataacttcctgcagcccgggtccaaccaacagtttacccaaagctgtccagtgagcagttggctgttagttactaagccgtcgaaccataccaatgtcgcacacatggttcgtcagcctcgtctcgtctcagccgcactacgacacgacacgacaatccttgcccaataattaatagccgcttaattaactcttcctcagttgaaacgagcagcaatagcatcaggaattattactcatggcagcgcccttgtaggtatgtgcctgtccatccacttcactttctactggtgtaaacgaaatcagaaaatcatacgtgtgtatatgttatagattccgacgtgctcgtttcttggataaaatgtatcatacaatccgattcatcgatcgattgccctgcacagcacagaacgccagtgtattgcctgcaatcccgcagaaagagttaactgaaacagacaaaaaaaaaggagcataacagtgaatcgcccatccatccgtcatccgttcccaaactccaggaccaaatgcatgtaaatatgcgtgtatgcatgagggaaaaaaaaagagagaaatgtattggtcaatcgctgcgcagcatactgtcgaccaaatctcccagcgggccccagaaatccttcccgctggccaggttgtgctcattgatgaacaggacgtagtgtttgaaactggtgttgagatgaggctccaatcctaggtgcacgactaccgggtaatggtggcagtagatatgggcgtacacccgatacagccgtttgaagatctgccgcaggaggcttgggaaggtctttgggaatggtacacctagaaccagaattagctcacggtatataaactgcatacgcagcgcataggatgcatacccattctgctggggaacatctgctcgttgtcaatgttgccctgaacccaactcatcaggtgctcgatatactccggtgcggacatcttcgtcggccgcttataattctccgagtcctgccacagatactcgaacctgctctgctcagcattcccatccatccttccatgaagtcttctgacgcgactcactcatctgtggctttcatctccgggcacgtttgcggggaacaaaactccgtaatcgacccgtacagaaggttgatttgattgtagaagtcgaccactacaggtatacgatcagtaggcgccttcgatgtgtcgcgagtcgatgcataccgttcactgccaaccattcattgagatcttctccttcgggcagcttgacggccttccgcagactcccactccccagagtggcctctgcaaactgtctcagctggtagctgctcgtccccttggttgcagagcggggtttgaaggggcccttcgttcgcgcatttctgggcggtgtcagcacatgcagcgtccccttgagagcttgcacagcgggagagagataggacggaggatcaagaagggagaaacggtgatgacgttgggtatggatggtctggcaggagggggagtcgctgagcgacgacgaggatgatggtgggggcagcaggctgtcagatgacatggcgacgttggggttggatacagacattgtggtgatgaatgaagccataataataaccacccaggcactccaccgcaagaatcaagatctcctttcgtttttaaacaacctcgacaatgccgtcagtccctctgtgtttcggtcgcggtgatgtggatcgcggctgcaacattccagtcagtcagtcagtcgctcagatcatactgaagcaggcgcatggcgtgcaagattctgagtcatacctcgtagtttaacgaccaaccctcgagtcgaaaattaaagcaaatgtctgaggttcagatggtagatcatctctggaacattacccttgcggcagtcagatgccatccgatgcgtagacctctccgctccagcgctgaccgccctgttgccccggtgatgacaacatcacgtggcgcatagaactactcctccatctacgatggctctacgtactccttactcttcttatcgacgtcgctgaagatgtgactgcaatggatgaaactagtgatacatatctaatagttgagcgttgtctcaaaattgtcgtaaagtacatcatcccagtgctacggctagtcgtgtctactcactgatacggacgtatgtgaaatctcatcgaaagcgaaaagatggtttatgttttatgaggtgatctccatcacttcacaccttgaccaaggatatataatgtacaaagctcccatagggcaatttgtccattgaaacaaacccagattgcctcatcctggaggcgccttcaatacaacaagcaacaatagccagacaaatccgttcgttcctcatatatagtatacctgattctcttcggctaacggctctcggactgtctccccatagacagtcagggggatcgaaatttcaaaagactcacacggtagagtctccactgatgaaaagacggagcccctatcgtcctcgccaatggactccaacaacctggcccccgacagacctgcttcgtcatcactgtaggaatgcgtcgtcacaaattcgaatcgcaattcccactcgagattgaccccgctcgtcagtaacgtcggcgtagcggagatcggaatggcgggggtgaatacgactcgagtggagaacaaggtattctcaaagtaggacgcgtagacgcggcgcgtagctcgatagatgctggcgctcgatcgcatcgcgagcgaagggtcaaccttttctgacgtctccagagttgctctcaacgaatagcaagggagcgcggcatccgagaagtccacggtcgcaaagatcgtctctccaaggcggtgggaaggacgattgaggaccacaacagcaatccgacgaccgttccgtgcaatttcgaaccgattcgcactgcggttggaactggtaatctgattactgcgaaggatagccaaatcgatggcatccttgcaagagggggactgcctggctcgctcttggctcggcgttttctccaagggtgtggtaggaggaggtagcgaactcccgggagcatgttgctccaagatctcatcaacatatgacaagaattcaggggctgtggtccatattggtccgctgatgctcttgtctttctgcagcggacgtgcttcgtcgctgctgctgacttttcgtacacgtgcttcgtcacggagaagtacgtacggcatcatgagatcatggccaagaacatctcctcgggcttggaactgtcagctcgatttcggtatcgccaggatggagtacataccgttaacgccactgaaaactcggaagggaacgttgatgcggttgacttgctgcacttccttggggccgctaggtcgctgggtaccaattaccaaattataggaaaacttgatcgctttccctttgtggctggcaggcagccctctgggaagcgtgaaggaaaatgagaacgatttctcctcccccggagcgagacggagatcgacaaacaaaagcgactgcggtgtagagagtaaaggaatggatttggaagaggttacaccgcgcatgtcccggagaccattgaggtcgccgctggaaaggagaccactgatggattcctcaatcgcattccagcccaaggcgctcaagagaccaccattgcggcgagttttctctgccgcagcgggaccaccggcactgctcccctgactacccacgactcctttccgcttgacttcttcaaacacggcctggttgatcaatgacccatcgacagtgaaagatgcactgatctgagcatatcccataaggagggtcagggaatcagaagacttgccagtcggttcgacgctggaataatgccgcctgtgtcgcgaaagattggatcgcaaacggttcgggccatagttcgtgtattctgattcaagtgtctccgtcgagttattgctcaaagagtagaattccccgctacttctgctgcttccattgacgctggaattcgaaatgatcttggtaaccggagccaaatgagcctgttgggttagagatggcggtgtatctcttgcggaaggtccggaaggcggacgcgttgcagttgcagaactttcatcattcgtcgctgtagtagagtggttgctagtaggctcattcggagtcggcggagctggcgggaacttgaagtccgtggggaaaggcatcgctcttcctcggggacttcgtaaggaatcgggtggcgctacaggactggctgcgccagaacccggacgactgggtctgagggatcgatctccatcaattctcagattcgcaatcgaaggactcaaagcagactcggctgagtgcagcccacgtgtcggggtcctgccagcttcacgtattgtcagccaaaacagaaacagatcctcaatggattgatatttagaaatacctggtgaaaagatctcctcgggacctgtagacctcctcggaaggaactgaaggctcgcggaccggccatgtccccaggctggccgagaacgactgagctgagacggcaccggcgtcttctcattccctccatcactctctatggacagaatcgacacggatcgcttgtgcttgtggcccgatgagggcggaaagctatgagcgacgcctaacggcgagctcaatgacgccgacgcgcggtgagaacgatcgaacgtcttctggcgaggagtttggggaagcgagcgcctgttgccattggcgaacagggcctgcggagacttgagcgcgaagtagccgtcgctgttggagctgccgttcagggaccgtgaggccttccgttgatgaggaggttgttgaggtccgctgctgacgtcgggggttccattctctgccacgttcttgaatgtgatgatgcactcaacgtcttctcctgcgaagatcgtctgctctttccatttcacagagacctgtatgtccgagggcatggctaccgtagcaatgtggttcaccgcatttgcgggtgacgaaagacgacctcaattcggcagtctgcagataggtagcggtagcgacgcaactagacagtcggatagggaccaaagctggccctgggcatgctgttaaagggggcgaatcattcccaaaacaacggacgacgatgaaagagctcaaggatcaaggccgactgaatgccgttcgggggacagcacgtcaagggtggagctcatctcaggcgtttgttcctgttggactccgcagacgcgatcgttcatgggggacggacggtggcgcaaaggggaaaagtgtggctggagttcggcgcctcaggcagagcgctccggtctcgaccactgttgattttttttgcgtaacaatttcaacatgatctgttgcgattttttttttgattgtgttggaaaatttattcagatgtccacgaaaatcgtattattcaaagtccacgggaagaaactacggccaggctgagacaaagagattccaattatatgaacaaccttttgaaattaaccgcgagagtactgtacaggggtataaacaaaattattacagaccaaaactcgtgcgccatgtccgagatagttactaatcttcgtccaaaatgcgagcatccgagaatggctcagcgctcttccgcctcggcctgaggccgagctcgaccatctgactccaaatcctctcgtgtcgcctgcgccatcgcctgcggcggtcctccatctcctcttctgacggccgccacttgctcttcaagatccgtcggatggcttctggcgataccttgaactcttccgcgaggacaggtgtggtaaacttatcaggagcgctggcgtgtagctgacggatcccatcgatagcgtcgggggacagcttcttgggtggattccagccttctgggaacttcctcttcatggcctctttatggagctgccatggctccttctttttcttcttcgtttcttgttgcgtacgtttcgccgcggagtcttcatttgcattttctgccttctgagacttccctttctcgcgcgttgcctttttctccgacttggaggccgcttttgtaggtgtcgattttgattcctcgataccagacttagccccttctaccacattatcctgtgccgcatctgtagaggtgtccctcggcttctcaggctcggtattgcgagaggcctcggagacggatggctggatcgacgagtcgtaggacgcaggggaggagaaaaatcttctatggtagggacttttaatctgggaacatcgcgtgtaggaagggaagcggctgctctgtgtagcaagagacctcggtcggacttgcaagtagggggcgatttcagcacgtagaatactctgcagtacgttggacagtgtgaatcctttggacacgacgcaggtcgatgacatggtggagatgtcctccaaaggaaagatattgggttagacaatcaagccctgcaggctggaagaatcgcgccgaagatgttcaatattgatgatggatgaggaatggcgagttttggttctgtagatccccggcgggcttcggacagagcctgaagctatcaaaaaagcttggcgccgctaagttaactcaaggagcttatctaatgagataaccgataactaagttaactagttagttaactagttaacagtaactatcatgaatgcatcttgcattgtattagtccttttctcgtgcgcatttcatgaggtatatgaattctacagaattttgcagaaaaccaggttgaatcctacaataatattgtttgtgctttcctgataagactctatacttagtatggttattcttactgtacttacaagccttacaggtctcgcttggctcgaccggttgaagagaaaatatttacctggtctatgccaaggattttctcccatgtagtctattatctgctcttcaggcggacttcctacttatatattctgctaatatgcagtatgttcacttaatctagccaccgaaatattaagaaatttctccttaagaaacctgtcgcattctattacagcaactataaggacgggtcactcgcagaagagaggaaatatgtgtaaccagttgcctacaggccgacccacaaccaacgagtccaatcatcaagatcctggctactgaacacaacatcctgctcaactggtgggttggcagggcggtcgaagattttgtcaaattcgagacgcagaggagtccccttgataacggagggtgtgttggactgatcgattgtgatttcttcagtcagagttgggaacgcattcgatcgaaggcaggagctagttttcgtaacaggcgctgctcctgggacccatttctcgatcttaattgctttgatagagggccggatccaaatcagcagaacgatgttgacttttccggccgagtgttcgatccaccacctggcatcagtatgtaggcgtggcattgactcagacattcctgcctctataacaagggttggccaatctcccttattcgacctgacacgcaggttcttccaggaagaatctccttcctttgaagaagcattctcaccaacatacttcgtagcgccatatcctgcgaattcttcgggaccaagctgcattgctgtgacagcacgcaccatacgctctccaaacatgcagtgagctctctcgtgaacttgagaggggagcttaatgatcaaggtctctatgtcaccaaagtaggtgaagctaacaccgcgcccaagatccaccctatgctcttcgattgtctcgaattgcttcggagtgacgtggctgaaagagagatgctggttttcgtctccatcgctcagtttcttgtactgagatgcaacgatcttcctcagatccttaaaggtcgagaacttgactggagggtatttctctgtaagcgccagctcagaggatggcgggactggtagcatcatggcggatgaggactgatcaacagaactggccgtagttttcttagctgcagtgaaaagtgaggaggactagtactgagagaagccatgttaaggtttggtagaaggcagcctgatagtgatgtcagtagacgagcctagagacaagcatgcgttgttggtagagaatgaaggtttgatgagagttgaaagatctgaaagttggagtgagatcgatggaagaactcgaattctttttgtgggtgagtcactggcgaggctgaccctaagccctaggccattgacgagttgcaggcagctgctgactactgtccataacaatcccaaaacaagcaggaacggatgtcagagtcacttctcaccaaaccccatactctggagtaggctgtctcgatccgtcccgtcccgtaatatctactctgtaaactgcacgtggtgactactattatttattattacgtacaattaagaataataaataataatctacgaagtactccgtaggtagatttttgtttcgttttgttttgttcctcaagtttatgaaaggaaggtggtaagtttagtcccttgtagtccctgcatataattacccaggcccactcgacccccgatgtcacctcatgacgcgtcagaggcccaagccaacgaaaccaacccaccaaatgaggaatgtgatgcctaaattacaggcatggtgcatctgacaatgtttaatggtgactgcagtccttgcacaactacagtggcttcaggaagttgtcaaaaatggaaaatggtgttgaaacttgaaacttaagaatattctaaggttcacaggatggctaactgggcagtacaataaataagcactaatgcaagttgcagctttttattcttatttaagtctgtgtacacatgaatagtcgttaaaatgcagctgtgcctagctctggcatattgctaactttgcactctgtactctccttgctattatgtgtactgtacacagaatcttgattcttctagccttggaggcttactcagacccagacttcctaaaagatgagacaatactaaaaaagccacaggagtcaggaccgtaagatttaagagcctcttccgcaatatgtccgaaacggcgctattccaacttcctgtccttggcacgctgcaccattgacatgtgcccaatctacgtctgcactacagtacacatccggccccatgacaagttgcatcacggcattcggtatttagcagaggctgcagatgtgcggggttagttacaccttaaccacccagcaaggttgtatcgcttgtcagggtgcattgattagtgcccttttcaatgagcttatttagagatctaactttgctggcaacttaaaagcattttagcattgatgaaggctccacaactggggttgccatgccattgccattgtattgcccgtgggaaatggatctgagtaagctgacactggacaggggcacgggatgcccagctgggggccttacctggcctggctgtacggcatataagatggcgccgatccatcgttctgctctccttccttcaaggaaggcgtagcaaatagcaaaatgttgctcgcgctgcaactcgctggcctgctggcctttggatcccctgtgtgggctcgtccccgtgcgagagctgtcacaagcccgcagtcttatgtcacctcctccgatggcgtctacaacctgagctcttatacggcccccgttcagggtccagggaatccgaacggtgcgtcgacatggaagctcgctgtcgacgacaccgacagcgggcacaagcaacaaattaccggttttggcggtatggtcttcaccgatccttgtcgtggacatatcactaaatgcaaatagcggccgtcaccgatgccactgtatcggtgttctcgtccctgtcgtccggtcagaaatcggccctcatcgctgaactgttcaccaccactcctgacgatggggtcggtttcagcttgatgcgccacaccatcggcgcctcggacctgtctgcatacgcctactcctatgacaacggctccagtcccgatccttctctggcagatttcagtctgtacagccctggccaggacatggtgagtctgatagccgacttcgcgtccgcaaactcggccctcaagcttctcggttcggtctggagcccgcctgggtggatgaaactgaacggggtgatgtacggcacgacggataacaacaatctcaacatggactacgcatcctcgtacgcaaattactttgtcaagtacatccaagccttcgccgccggaggcgtcaccgtcgatgcgatcacaatccagaacgagccactcaacagccaagctgggtatcctaccatgtacgtctcagcggaccaggagacgcagctcattcaggactacgtgggaccagccttgaagaacgccaatctcgcgacggagatttgggcatatgaccataacacaggtgagtggggaatcatctcagtcttatggggacagacctaacgggtgacagatgtgccgtcgttccctcagacggttctcgatggtgctggtgactacgtcaacacagtcgcctggcattgctatgcgacaaacaacaactgggatgttctgacgcagttccaccagtccaatcctgacgtgacccagtacatgactgaatgctggacttcgccaacgaattcgtgggatagcacgatcgactttgttatggggtgagtgatgtgttggaatttgaactttctttattttcttgcgatctaacccttgtgcagaccaatgcagaactgggcctctggatccatggcctggactctcgcaaccgacttcaactacggccctcatctccccggagggtgcacgacctgccggggactggtggaaatcgacaccagcgcggggacctattccaagacgctcgactactacctcatggggcagttttcgcggttcgtgccgcggggcgccattgcgcttaacacgacgggcagctgggactacgggaacgaccagaaactcgaggcgatcgcgttcttgaacccggacagctcgcggacggtggtgatcgagaacacattcggcaatgaggtctatgtgacggtcacattcaacagtggggaaacgtggagcggaccgttgtatcagcagtcgctgacaacgtgggtgttgccccctacgagtggatgatcggcagttcagggacagagagagctaggtaattagccgggggatatggagggaaagtccgtcattattattattttcttactgcatggaattagccttaggatcagtttcctaattggtcaggtactccgtactgtaggtactgtacagagtagtgatgcccaatggacagatacactataactttttacggaattaaatctcgctttgcttttgactagcaagcaacccaaagtttgagactgtcaagttgacagtggaatttgaagcctgaatggtggaaggttggggaaagaaagtctactagtatccattagtgtgactctagttagaatgtgcggggattgtttacaccccgcatagcaattcaatttcatcgtttcatctaaggcatcgcactagacaataatagattctgtttcttcttgattctttttttttgtcatttttcacacttctgttatgattactccgtacggaatattttgtccataaactggacttcccttatcaggtttagcaatcctgtgatgtactccgtattgtttggcgcagttcaatcgctatcaagactctgtggatgctactactgatccatgagaatgatttgtctatgccaacatttctgtctacaataatgccatactgtcgacctagagctgaacaaataagcatgtttgattctttcacatcgctctttcttgatcaatgtaagccctggaatgtacatacattatgtgatcacgtgaagggacaaggatggccctggctgtggggattgtgccccgcttagcaacttcatcgtttcatctttaacgcaactccatggcattcaactagccaacagatctttctcgtttcactatatacttgttatatactgtttctgagttgctctctcctcgtccatatacatatgaggccaacaactgcagactcgtgtgctgtactgtacatgtatgtatgtctgtatgttcagttatggcgctggacccctccagaaactcacttaggagagagcagccaccacatagttatagttgcatagtcccgtcgtctgggcctgcacatcttttgtcccagtggccgagatgatcgtcttgttggagctgtccaccacttcgacgcgctgtccacctcccgcctgcaatccgggcaccgactgcccgtttaggcccgcattggccgggaacgacccaatctgcttattgttgctatacacgttgatcgtgtaacctgatgcgccctccggaaggatgacggcgaagttgatcgcgtcctgcgcgttctgccagcccgacggtttccccatggggtcgggcgagcagttcgccgtcgtcaggagggagcggtaccacatcaccccaacagccttgcctcctgccggcgtgatcttagagatgtcggtgacgttcgatttgtacgcgttgatgaatgacggcaggacctgctgccatcccgtgtggtcgaaaccgttcgcgtaattgccaatgtcagtgccggcgatctgctccggccagaagttgccgacgtagtggctctcgcccgcgtcgttccaggtgatcaattccacaaagtcaggctgcagggaaagcacctgctccatgcggtcgaaatagttcagttcgccgatgcggtaccagttttgaccatctccgctcatgtgtttgaactggaatgtggagagggctgttcatatacattagggttattcacacgtctaaagacaggactagaatatcgatgtttaacttacgcatcatgtacactttatttgctgcgcgagcctcctggagagcagcctggtctaccgagtcgctgacattgaccttgcccgcgctcacctctggccaggcagactcccaaccaaacacgccgtccgcgacagtgaaagtgttgaagaagccgttgggataaccactccagttgtcaaagttcgggacgaagaacggattgatccccttcgcctgcaggggctgccggaacttggaattccagtcgtcgttgctgatggtccctccggagaaggtgctcacgaacggccgcccgtcctgctggagatacgactcgttcgcggcgtactgctcgattagcggcaggagctgcgacggatgattgaactgcgtcatgtcgaaggagaagaacagcttgaagttgctgccggcgttgttggcggcgctgaacaggtacgagatggccgacgtcgcccagtcgtccatgctggggacattcagcgcgaaagcatcgaagccggcgttgattgcgtctttgacgtccgtcacggcttcggtggctgtcatggtgcccacctggggtgatgtcgtattaacgatacgcaccaactatatccaagtcaacctccgacataccatatagtgggcgaagacggccttggctgccgcatatgagctacacacagggagagacagaatcaaggagcgtggtaggcgcatgtttccaaagaaggaaactaaaggaaaggcgaaacaacgaaacaagaaatgactattctttccagccaagtgtaaggagtgacagtagttgttcacgtctgacgagggctacaagcaagcaaaaaacagtgagacagtcggttgaagagggctccatatcgccgccagggagatattatcccttataaccatccctccaacacgttcacctggtagccccaatttttttcctccccgaacattcccacgctacgatgtctggcattctgactaacgtcgatcattaacgcttgttgactggttgaggaatatgacagggaggagatgatccacgggtggtttgggactcatgttggttcggtccatgaagtttaatcctatgggagctgaaatgaaccaacaacgccagatcgaggcagttcgtcatacggccttaatgttattgtctccactcctttcaaaatgcaacccatatcggtataatatcgggcgaagtgagagagtagcgagatgaacggcagttggtgatctacgcttgcttatttcaagatccaacagcagcgaatcgaatccctgcgcgccatgtcgactgagcagggtcacacatcgtgtcacgaggaagccaatcgcaaatgagttctgtagcgatcgcgtggtggctctgaggatagttctacggctcaggcagatgcttattgacccagaaaccgccgaaaatcacgcggaccataatcactccagtattatcattgtaccaggttcaggcgagtgaaccaatcaggatgccaagctgggaaatcatggacggtacgaaggccactccgtccatcacgacccatgggtgcagcatgggcttccccaggttttccaaggttgatcaccgcataacagccgagtcataagaccaataaggatgcgcacctgcggtgattgccaaagtgacggtttaatgccggtgccaccgtttcctcgccgtcggtgttccgccaagtcacacgcaaagaagtaaaatgtaaccctctgataacgaagaaaaagctaagattgtgtgacagtccttgtctttatactcagtactgtactccgtagatgtcatgtcatgtcggtttattattcccccacattttttggtgttggtcggcatcccgatttattaagtgggtggagacgtgactggaatgctaccctgaggaatctgccaggtttcaatcagcaatagcaggcagatcccacgtgtttcagcctggatgaaaattgttgccctactactactactactattattattattattaccatcatcatcatcatcatcatcatcatcacacgcgtgaggaaatatctgtccttgcagatcgttctaggaagtaagatcgtagggaggaggaatacatattggcctgggtcttccttgatgctgcccttgttgtccctttcgtcatgctctttttcctcctctctctccttcctctgttcctcccttgttcgttgttggggccaacacccctgttgtttgaagatctacgatctggttatgctgtccgaaaagggtaatcctggcagataaccgccagaaaaacaaaagaacttgtggtagcgaggtacgggttaaataaaggagaaacggactcacacgtgatacctccaatgccctgaagataatattaatctcctgataatctccttacgatgcctcctatcgactctgctccatgcgttccctgctgttgggtcggccccactggggacttgcacaggccactcgacgggtgatcgtctgctcgatgtcatccaagggcacaagatgagacctcctgctcaacgtcgcgtcttcgagatcaattgatcgcagagacacatcgcagcgtctcgacgagagattgacaggtcaccagcgttgacgcaagagcaccccttttctccgatcatggcccaacagccgcagggccgggagctaggagccagccctaggccgcatctggttggccggcactcagattggggaatgcaccaagccgaccacagatccagtcgctcctccacagctgcacagctccgtgtttactgctctgctcgctccacgccgccgatttaatcatatcccttgtcttcttcttgcccagtctcactttcgtcactccttacctggttcatcctggcttctccgctgacgactcgccgctgacgaccctctcgctctttgtcccgaccgcctatcgctgtctctaccgccctttgtttaccgcgtccaccatctctccccgcccttttcagccctccgattctcccttcctccttctcgagcgactgctgcgaccatctccacatgcagacattcgtgcccttgcctccctgctgatcctacggtcgaagcatagtcccaggtggaaatcgctctcgaccgatgcagtctcctgaaatgaccggctcatgtacttggatgtgatggcaaataactcgtggagcgcgaaaaccaaattggcagcagggccgggagcatcgctcaagatcacgccgtcaaactcccccgtactgagaccgggcacgcgatcccccaggacgtccccccatcaagcaaccctctcccttcagacggtgatcggcacgacgacggcgacgcccaatggcttctcttctcatgaaccaacccgatcgtttgccctttgtgtcggctccgctgccatcctggccgagatcgatgccgacagcaccgtcagtcagcgtttcttccgggcccgtccgacggcgacgccggtcaatccggtgacttcgttctacaaccagcagccggctccgacgaccccggataaccgcaatagatctactcctggcaggctgggtgccagtgcgagttgctatggaagctctccgtcaggcgactgggccgattcgactggttccaggacatggacgtccagagagagaataaaggcagtgacgagcgttgcaatcagtccgaatgggcgattcctagctgtgggagaggtgagaatttggaaataatttatatacacgaagaattgcactggactgacctcacacagacaggatataacccccgtgtcctgatcttctccacggcgaaagatgccccacgtgatgttccgctgaccattctaactgagcattcgtttggtgtccgcggtctggcgttcagctccaattcgcaatatctggccacgctgggcgacattaatgatgccttcctcttcgtctgggccatcaacctccgaaccggagctgctaagctccactccacgaataagtgcacgtcttttgtccgcgatatgtgctggatgggccagactctgatcacgtacgacatcgctcgtcccgtgccttttttcgaatctaaatactgattgactggtagggtcggaatacgacatgtcaaagtctggagactcgccgatgcagcatcagggtctcccacgaaaccgcgtcccaatggtgatgccttcttgaactccccaggcgcagctcccaaggcactttccgggagaaattgtctattaggccctcttggcgaccatactttcacctgcgtctccagcatctcggactatgaagctatcatctgctctgagagcggtgcagtctgcttcctagacgacactgagggcgcccagaagttgacttgcgtgaagcgtctcgagttcggcgtctactccatagctgtagactctgagacgggcacggtatggctaggcggtcggggcaggaaaacattgaaactccaaattgaagagctacgggcaatgttgacgtctgtatcgccatctctgaatggctcgaatgatacaggaagtcctaaggggagattaccggccatcatatctatgggatttctctcaacgcatatggtgacggtggactcgacacgagcgatccatgtctcccctatcgatgccttaggcagcgacgacgaccaaagtttcatggaggcattgatgcccgcccaccgggaccctgttctaggggtcggaccgcttaaaatgccgaacgcccacgatgcggactttttcacctggtcttgtgagggaactgtcaacttttggaatctgcagggcaagtgccaggcgacgagaaaaattgagctcgagcagctagggaccagcgatgatgaggtttctaatgagcttaaagtcttgcgcgctattgaggagatggactcgttcgtatctggtgatcgatacggtgtcctgaaggtgctatccgcgaacccgtggaaatgcgtcaacgaggtgcgagctcatggcggtgaggtgactgatattgccgtcctgtcgtgccccggtcattgtttggttgtgagttgcggtcgggaccggatggtccaacttttcaagaaaacagaggaggcgttcgagttgattcagacgatggatgatcacgtcggcgccgtggggcgtgtgctcttcatgaatgatggggagcgattactgtcctgttccgctgatcggacagtgatcatacgggacagggcgacgcgagaggcggatggatcgatcattaccgccttcatactgtcgaaggtcataaccttgaaagtgtcgccggtttcgatgacattggctcgtgatgaccccgacaccctgattgtctccacgatcgatcggcaaatacagcgatttgatgtgtcttcgggacgacatatccactcattcagagcatccgacccagagacaaacgatgcggtggtgatgagctcgttgattgtaagcagtgaaattccgggacacagcccgcgactgcttgttggagtctcaaccaccgataagtcgatccgggtctatgactttgatagagacacgctcctcacccgggaatttggacattcagaaggcgtcagcgatgtgatgctgttggaaagcagaccatctgattccgcggcgggcaccaagcggactttgatcagcaccggtctggatggtgttgtgatgatttgggatctgtccgtccagcagcagcaggtccaggagctttctcaggcgaatatccgcgaggaggatgagacacctgcgaaggagttgacggcagcaaagcctccgcttcgccgcattctctcaaggtccgagctcgcgggattccagcggcaggacaacccggcagctacaccgacaccggtgcgtgatcagtcgccgccccgaatacgaaggaagggatctcggttctcgctggctccgccgacgaacaagaatggaaacacgacagggggggatacaccaagccctttgcctgctagccggcgctctccagcatcggtcatctcagacggcagaggaaggtctccttcgcctccgagcccaaaggctaaagtgaacggcctcagcaggacttcgagcatcagtaatctgcatcgcccgtcattggacttccggtcacgaacgaagaatacaagcgagttcggaagcttgaacatgtcaaccgagcaggtttgccgcacgttgcgggcgtaccggaagaaactcaacgggtctaccgagtatccacgttgtgcaaaggagttgcagcgcgagcttgatctcacaatccacgctttgggtgaacgggcaaagaggcatcaagcgaatgcggacacggaaaacgatagcagcggcaaggagaatgagaagaagcccgaaccgactcccagcaagccaccaaggattgctagaagagttccgtccactccggtgttaggccagaagggatccagaaggatatcgaggagtcgttctctagacgcagacggggaggggtgatcatctatcatctccggcactcttttcatcattacgactgaattttttgaatttgggttgacggttggctggagcagggatggcttcggagtaacgttcttatattcactcttttttttctcctttcatttcttccatgttttctctacagtgacagggcgtgggataggcccggtggacttgattgcattgtgctggatcacgttgggttagggttttcgtcttgatgcgatttcgtggttgattgctttgtgtactggcgttgcaaaagttccaaggtcaagcgtgtcactgtcggcctggttttgttttttcgtttcggctcttggggttttaggagccttggcgattcttttttttttacttaataccgatcatttttatgtccctttctttcgtttcctttcattctatttctctttgcttgcttgcggaagagggttgcctttttatttatttttaattcttttttttcttctttcgcgggtttttcatgtttgacgcttcaccacttttttttaccacttttttttcttttaccctcttcgtcttcttattaactttgttcttctattcttactagatagacctttttttttcttacttagttagaagatacccgcgtttacggaccttgagcatgattgattgattgattgagatgagaaagaaatccttgctcgagtcagtcccagcacagcaagcgagcgagcgaaccctctgcctctacctctctctcctttctggaaagaaactggaagagagagagaaagggagggagggatatccatacgcacttgctcgctcgatcgaatgtcattgaatgttgtcatttttccatcttctttttttcccccatcttgtaaacgtttctttcttgttttcgtatccatctgcctttgaagaagattcgtagtttatttgtctagactctagacactccggttttttattattctgatattgaaggtgggtacaggtacctatgtatgtatgtacatacttacagtaacctagctagtcacctatgtatctaggtagctagctaggtaagtaggcaggtagggaattccattctaagtagttgattgattaatcagctttcttgattgaacagttgaattgaacttgctcgatacaatctcccagccttcttttttttttgtttcttttgtaactcttatttaaggtttaattaatattaattaaaggccattctcacaatctgtttccattacaaaatagagaaaaaagatgaacaggagatgaataatcaaccaccaaattccgttatcatcatcatgaccatgaccatgaccatgattaaacaatcagaatagacagcatagacagcatactatgatatactatgtctatgtttgttgttgcaacaactcgtcaaatctcccccgcagctcatccaccagtttccccttgtccttgtcgtcgtcctcgccgcgaatgagttctgccaactcgatggctttgcgtgcccagcgtcgtgcagtatccgcgttcccctcggatctggactgcagggagagatggtagagatccacggcgtggttgaaggcttctgtgctgaggtattcgagttcttcacggggataataataatcatagcgatcatgctcgtcggcagggttgttgctgttgttgctgttgtttgccccgtgtcttgtgcttgtattcatattcatattattcatattcatatccatggccatatcccgagcaaggatatacgcttgatcgaggattagctccgctacggccgtgctaatacaattagaagagatgctgctgctgctgccgccactgcacgtttttgttttctgtttcccgctcaatgcgagttcgaataggcagcggaagtatcgtgggagcaggtgtcgtcgtcgctgccgtcgttcagagttggatgaatcgccagatgggatttggatttgaggctgcgacgtgcggattgcatggaggatttgctgttaattattatgaacaacattaatatactgtaacggacgttttccggtttgttatatgcagcttatctgataacatacctcgagaatccttattaccctctcaacaggcgctcgcgcttcttctgcacacagcatcatgtccgcaaataccgcgtataaatgatgaaggtcgtcgtctgcgatcgagcgcgcttcttcaaccagcgagctgagatcgttccattgtttcagctggatggctgcctcgaagtcgagtgatagtattgcttggtagcgctttgtccagattgaatgagcggttttgtcactgccgtcactgtcgtcgtcgttgtcgtcgtcgtcgacaattcgatttcgatctagctgcttcagttgcagttggatgagattgcggaaactatgtgcgtgagctcgcacggttaggtattctctttcctgtagagtagccagttagtgatctctctgcggggtacagtacagtgcagtgcagtacagcacagggcaaaatagaaagttgtagcgagacttcagcagttagcatatggtaaacggggaagctgactctgatagagacatcactttgaagccgtgcacgctttgtgatcattgtcgctgcgagcaagtcacataaaatacgtctctgacgaaggtcggcttgcacggctgagccaaggtcgtttggatagtgatctagtagctgttcagcagtcagccgatggtactgtataaatttattcttttttttttttgagagagattattggagcatgggttattgatatatatatatttataattaccttgatagacacgtccagcagacgtaggatcaattctggtgaccatagtttgcacatctccagggctaacctgtagctgttgcttgaaaaccactcaagttcgacaagtgagaaaccattactgttccatgagatattgtgcttgtctgcttcaagtactgctgcgctaggttagcgttagttctttgtaagatcgaaaagaggcttacaacgctcgaaaatcgtgcacactcgttctctaagtgctggatcattgactggattctctctcatctcgagtactataagtcgagcagtgcagctgaacaggttagtaaatcgatgagaccaacaacgtcagcgatctcataccgcaacaaggcaggcaagctgatcttggtattttgactgtccagacggtcttgctttttcagaacttggtctaacgccataatcgcctgttttctgttccctgaacactgcgcttcggatatgcacgcgagaagatacgccatgcctccttccgcgtctagtttggaaagggaatcgaggcatgtcgtccctagttcgcggtcagagacaacaacttgagaatgtggattcttcagtcctacctgagtcgatatcttcatccttcaaggatagcttgtacatcaggtacgtagtcgaagggtcagatcggccttcttccggcagttggtaaaagcagtatttcaccagataactgtccgacgtttccagcgcacagagtgccattttcctatttgtgaaaatcgtgagctgatggctgaatttgaagtcagtgtgtctaaccttaagatcttggaccggttcgcaagcttcgcctgctggaagatcacatgctgaccaaaacggcaccattcttgggccgttgagaagtttctctgcaaaaactcggattcgatcttcttccagaggatctgttgcccattgttagtttccatcgagaagaggattggtgttttctgacaatcaaagacgcatccgcagccgtggcgctcaaggacaatcgcgaggcgtcgctcaacttggttgctgtatcgttgaggaattccaaacaatcctgagtatccagcgatgccgcagtaactaatctgattacagcaacaaagcttctttcaatccatggcatattatcatagactgcatgcttctccagaaacagttctcttagagcctcgagggatagttgaggactatctggtcagttactgtctttctagggaaaatgctcaggttatacctccagttaaaaagtttttgaatgtaatacaaagctctagataaaacttagcagcagtagtctctcaacgacggaaggcacattaccttcgaaagttcggctctgtaggctccatgatttggataagagtttccagggcttcagcgcaatggataagttacaatgccgttgtatattgacggaacgcactcaccctcatagaagccttgatgatttggttggccttgctttaacatggcttcgagctgtaataccaggatcgggaattcctttggataacgcttgacacatgagaggtccatctccagtgaataggttaactaactctaccttctgtattattttcattgtttccattgcttgactctggaaggcctctgtattcctcccaagatctgccatgacttcattttctaagtctgaacaacctggcgatccaggatatgacttaccaagagtctgaagaacggccagatgaatgcgtcggaaatcgaaatcagacttgcgtgtgtctagaattttgagcatttttgacgccctttgcaaccattctatcgccaactctgtcttattgctctgaagcgcccattttgcgatgttgttacacagatcggcgacctcttctgccatataaaggtcattctcaatagcagattcaggaatcttagacaacatgtgctcagcaagatggggtttctcctgacgcgatgactaggtatacgttagccccggtcctcttgaaatgctgtaatggacttattacgaggaaagcgcgaatcaggtagtatctcgcgaaaagagcttgggtgctcctgaaatcgtcattgttatcgttatggcatgtctcgagtatctctatccgtgcagctgccctttcgaggatcttcgagcccagatgtagctgtttgctctctatcgccagaaatgagcctggatcagacattgggatatggacctcaaaccaatacagaattttgcgcattttagtgccacctgaagagctcttgtattatctgcagaggccaataattagttccagccgtaaccttgacaaatgggtacctgcttatgttttcatttgctcctcttaacacacagctgtccagcatcagaaacgaaagagcctgcactgcgacactacttattatcccatgcaatttacgcggatatagccctgagataccttgagtaagcaaattcaggtgacctccttcacctcctctttcatcaaatatgcgtgccagccgagtgcaggaattccatagagctgtaccggacagatcaagcaaatgacgagagcgagcagaaagtaacgaaggtatcaagggaagacaattaagatattgttgaagtgaatcggtaacgtcattgtccaaagccagcgaggcaaaggacgggatatctgcgatctggacttgcacatccgcgacaaatgctatttcgcgagaagtcagaaattcaacaagtcagcaaatatttacagaaatcgtggcacttcaggaaactgttgtttcttctgaatggtcttgacatggcagagcctaccacaaacagatgcagctttctcatcggaatctctatttgatgaacatgccatggtaacttgtagataccgttctgcgataacaagcaagacaacgaagcccttagggctttagggagggttttgcgtcgtgtttaccagaagccagagtgatgtagtttcctggctacgtctttccacgacgggtaagttctgcgcgatgcgctcacctgacacggctactctcagaaggccttcccggaatacatttatgatgtcaaacagattggggcacaaaagaaaaacctaggttatctagtgaacccctaatctgactgatatctgccggttgacatatgaaaattagaccgtggaggaaccttgacacataaatctaaagagaaggaggaaaccctggtagaaagacaatcgagaatctccgttggccaatggcattgagactagatatacgccagtaacgccatgaatagtcctacaagaataatcaatatatacgatacaatatacatttcgtaattcactgctttagtcttcgtaggcatgctgcatcatcgtttcctcccttgtgttggtaaaaagttcccaacaataagtgccggtctggagaatttgttagcaaatattattacatacagtggaaattatgacgccttacatgttgtatgggtcgcgacggattgtaaatgaaaagcaacacggtatgccctgcccggagttatcggaattcggactcttcagggtgcagcttgtgagcatggctttttgagagctatcaaaagcaatggccccaaacttttcccagtagctaacgagttgatcctctgtaataatttcgtgcagggcaagctttccctagaataaaaacagttaataatggcttcatcaacttcacccgattccgaatggactcacgtctcgtagcatttcaataggcacattaatgagctctgccatctctttgtttccccggaatatttcgccagttcgtctccagcagcaggcagggatagccatactggcaaaaactcggtcgtactccatgaggctccgttcaaaccacatttcgacgtagatcagctcgatatccgtgaggctttgcatgcgttcgcggaatttcggccggaatttatcgagctgacgaagaattttctgtcgtaatgccggttgcatgtgcttttccatgtattggttcaaccttgcgtagcccttcacatagttgaatggtttcaacattcctgcatcgtactttgccttgagtagcttgttcatccgctcttccggagggtccatccccgacggatcggcagcagtcatatagtaagtctctttggctttatcgtttgccacggcagagctggggcgctgaatcgagttcccctgagcattctgattttgcgtttgtggcgccggctgtgtctgctgttgctgtggaaagactaagttatttccattcaagtttgtcgtcattgaatttattagagatgaatctgaggagagtccctgcagatcatccccttgatacatggagttatcatctaacaggctattgctgaggaagtcgccgagcagattatactcattcgtcacttctggcgcgttgaacatgtaggaaggatggaaggcatgcatgtcttggaattgactctgcccgctgagctgccagtcattgtaggcgaagactgtttccctagttagaagattggatcatcacacatagcgatttcacatctcacgtggctgagggttggcttctaagttctgggttgttgcaccagatatattccccggctgcacagcttgcggcgggttcacggttgatggccgaagactcagagctccctcagcgagcatttgcttaccagcagcgtctgatactggcataccttgcgagttcgtgaaatcattgttcgacgtgctctcttcctcgtgatcgtttcgattccgcttcgaagattctcggggctcatcatgacagagatggcctatgttgcgctttatgcatcgcgtgcacggccgctcctgtacatccacatctgcatcagatgtggctgctccatttgtccgacggggggcgaataggaaagatcataccgaatcacaagtcatatgctgtccaaccacagtacattgtcagctcaggaaaataaaaatttctggataatgcgagtaggtaattgcgccaacgagatgcgctgaggaaacctgcaaagacggtgttactcaccgaacgtcggcaatagacacatgctgttgataacgaacaatcagatcagcgacacttcatccagaacctcagtgaggcagaatttgtgcgtttttacttaccatgattgactttgcgacgcttctttgggctcgcgtgcgtctgcgcagcagccgcctccgtcttcgtggttggcgaggactgctctccgctctttgcgttcgaatcctttgacgatgattcattctcagaagcgtttgactttgccggttcggttgatgcattggtcttgtcctctgctgctggcgctttcgccagcgtcgcgcttgcctcggtcatcggtggctcgagctatcccggccaaatgcggggaaggacgctttgttggaaggcgctgttccacaattctgcggctttgatgggcatgaaatgatactgatatcaggtaccaacgcagtagatcgaacaggaggagaagcagtgaagacgctaaatcgaggcaggcgtttaaacttgcggagttctgtcgccgcagtgggacatgatcctctcgtcacgccgattcccctccgcaaatcgaggtgcttggccaagctcctctttccggggcatccaatcaggattaattataatgccttagtaagcatactattatctaacctcgcattagcaagacacgtgccaattggcaaatggagtcgtatgggcaatgatatattctagaagggtaaaggaggcatacgttggcaatggatatggccataaatctgggtaggaagcccgcccgggaaggagatgtgtgtgtatatatgtgttgggaaattttggctcacagacctacttcgtacagtttttatctcctttccaggtgggcttcctactcgtatttctcatcgtattgattacaaaaaacggcgtagaaggtcaattgtgctgaccttatggcctagggactcttatttttcttttaataatgataaggtgaggagtatggatatgtacgacaagatcttgcgtttatcttaagacacccattcttgtattgcttaactacctatttagttatcagaatgcgtatgaagaaaacatcacaagattatcctttcattaattatgtagctgatctgagaagttctgtactagtactacaggggtatatcatctaaagaagtaatacacaataagtgatcatgtcccttgagctatactcattccgcaggcatggataccagatccaaagccacctgggcttgtatgattgcgtcctttagtccaacaaatggagtgacgttgttctgcatcgactggaggtgcccgttcagttgcgttaccaatgatagaagctccgggtcaggtttaacctgtttaggctattagcaaacacacataagggaagggctaattcctgccatacatcacaaagtgccgtgtcaccatcctggccgtctataactgaaaaaggggcggacgatcctgcttgatgttgtggtaaactgtcgatatgccggaggacaggatgttcctagtgaatgaaacatgcattagcgaggttatggcgcaagagagcagacaggatacgggttttagacgacgtacatttttcatctgcctcttccgttctgcctccgcccttttcgcattcttctccatttcttccagttgtttcgtctcctttgctagcaatgcctcctccttcgcgatttccattttcaagaggtcaatgccgtttgtcgttgtggataattgtgcctctaaggaccgctggatgatgaatttattatcagtgaagcccgcttagaattgtctgggcacagccaacatacatgctcgtgaagtaaggattcgtagtcgaaattggtatcctttgtaacagggggaaatggcattcgaggcagccgtcgcccaagactaaaaaagatcgcgaagaaatcagcttcaaattcgccatgtagacagtaaaagcaacccaatatcatcctctccatttgcaggatagtatgcgccattggaacgtactttttcacgactgcagcgactgctgtctgggcctcaattcgtttgcgctcatcgcgatgtcgcacgatgacggggcgctctagtgatcggaacatctcgcggaccttctcctggactggctccggaagagtggtccatttagacttgatcgtacgctgcgaaatgtgacggacacgaggtttgaggtatgcaaatcgcttgttctgcgctgtcgccccgtcatcatcatctgatcgctttcttttcggagccattgttattgtcgacgcgcgagctgcaggggacggtcgaatgggcgggcaataaacgacggcagaggctgattcaacgatgaataatgattctagaatctggcagctcaggttcagatggaggcaatgataaatgacttggtgtgtgacttaggacgcgtctgctgcagcgttgcacaaagcaccttcacatgtcagccaaggcgaggtgcctactacggagtagctcccgccaaccgtcctccccgctgtgggccatcgtgtcagcagccattttagacccattatttactgacacaactgccactgagtggcgctgtattttaataattattactggcgtacggggaactaaatgataacagtctctatagaggttataacaacactttgcagtttagcaaagacaacaccttactttctatccacaataactgtattcccatgacttgatacaggcacgtaaggagagacgttctctgacaacccattccgcctctaacaatacagagagaatagaaagagcaagacgtccgtaacctgccgactgagatatgtggctgcgtcaggtattttccttattgggatcaggcccgatgctcgctcgaggcgaatgcgttctcgatcttcaaactcgaactgagtaaagaatttgagatcggtcggataaaaaagtccaacccggatcctgattgtagtcgaaattcgtatggcagagaccacaaagcgctatggcgttacggggggccagtaagctcgacatctatgaagtcacgggcaaacagaactgagatctatagaaagtgagttgattggcataattctttccatgtaggtggcagagatataccgcaggatcagacttcgccaagatatgcactgcgtatggtggcatgcctccacaaagccagcagcagtctcctgtgagtctcctggcttccagctttgtgctggtgggaaagcatcagaaacgttctgtcaaccaaattggggcacaaaggggggaaaaaaaaaccctaggttatctagtgaacccctagtgtgaatgatagcttgcccaggttgacacgttgtcttcactagatgcccccatcccttcttttctcctgggcttttgactaggagtagagcgtctagacctgttgtctgcttggttggccatgattgcatttatcatttgattgctaaacaatgcagataaatgaggatggttaatggttatcatacaagaacacgatctggattgattaccagcgattctggttttaacttcagtgaccaaataggaaccttggaagtcttcaaggttgatggttacaatgaggggaagagaagggcaagagaagggcaagttcaacttgaaaagtacttttcaggcaactgccgacctacagctgggagacaagtcacgcctgcctacctaggtagacaggttttttccacccaccaatatctcgctccagcattaaaccctttttggggagcagcacctgcctgataagtggtgtccgcatcatgatgacaattttgaaaataaaccttgatgtatccaaatggaaaaaatcatgaaaacccattggagaacaagatctcatattatcattaaaaatatttcactcgtaaaagttatagacttatacatccatgccctgtgatattttcctatgtatccaaaacaggaacctccaagctcggttttaataatcctgtacaagcggcaccgcctaatgcattatgtaccgtattcaaagaaaatccctggcatccgataccaatgtgccagggtatttcaactcgagaatgacagaatagaaatgctggtcctctggcttcaaatctgagtacccgccccagagcagctggactggcatgatggaacagtacatagtagtgcagagagagtaagaagagagatcaggaaggtgctgaaaggcggtgaagtcacaggtcatctcggcattataaagccattcattgctttcaactccgcaagttgagtcttcagcagctcgttcccccgcaagatatcctcaagccagtttgcagcttgggcgagcatggcgctcttactgaatccaccgcctcgtagttcaggaacaagtgaacagagttcatcaaagccctgtttgatgagatttcgtcgcttctgttctgataaaatatgatttgtacgtttctgctcttctgtcaaattctctcgtgcaggtttgttgccctgttgcagtttcggctttcgcgaggaattttcaccggatgctcgtctggctttgttgctgccggaactcttcggtcttttggactttgagagagtaccattctcatcagaatcatcagcctccttggttttagtctttaaccgcttcttcggcggcatactgttgtcgtggttgtcggggtccccattttggagggcatgaggcagatgcgccccattcagaccggtccaatctctatgagaactttcgaacatcctcaccggcgttggggctcttgtgttgtttgtgctggtttgcggctcgagacactccaacttattcaacaggtctttggtgcgttcctcctcgttcggcacatctggaggggccatgtagccctggtcaacaaaactagcatccgatccccagcggagagttctgaattttgcgctcgcctgcggatctagcggtgcaggttcctgcacattgaagacttctgtatgctggcctcgtaagaggcgtttccgagaacttcgagggctggagtctgccggcgtatgatgatcatctgacctctcttgcttgacgaaacctgatgcaccggagaaagccccattcattccaggtaaggcattgtcagagaagaaatgatgcgtggacgttgatccgaaattagatgtattcattccgttctgatagagcattgaagctgcagctagtatatccgagcttgtgctcatgccgttattcgtcgaatcacctcctcctttcgacgcactgtaaggtagaagggatggctgggatagtgatgttgttgagccttcgaatatctggggaagctcatctggccactcgagcccaagggctcctgtccccttgtcttgggtctggtcaccaaaccaagcgtcactcgcatcaagatggctcgaattaagtgtggtgaagaagttatcaagcatgttagactcgctatcgtcgaggagagcaggtcccggtggaggggcagggccgacatcgtatggcgtgtcttgtggtgagaaaaacgaatctgcatatcaagaatcagctgcggagttgataaataaattcaagatgatgcgatcagcacgcacatccaaaaggacccgtttgttggctagaagctcccgtgcgcccattacgggcttcagatccagttgcgttcatgacagggagtatgcccaagcctaatttcagcagtaatacctgctattctctgtcttcgcggcgggcttcggccaggtaagaatcaacatgccttcccgaaggaaaagcaatgctgaggatgttcacagtcaaaacgaatgcaacagagggcggcagactgaagtacacgaattgatcgcgtatatacaggtgatgcgcagggaggatacaaggtagttttgtgtctcttcgcaatcagacgacgctgcggcgaggaaagcggggtgcgatatggggaagacagcgcgcgcccactgaggtgtgagataagcgctcgaaaagggtcgatttcccagtagcgcaaagcatcgacaaagaaataagaaccaggtatagatcttgaaacggagattgtggagttggccgatatgtggagagctaaggccggcggtatcgagagtgccggagggagtcgagtgacaatcacatgcaaacttctgccgccgcagagcagcacggaggtcgcgtgacgtaaccccaataccaatcttacacggggcctgcgctgcgccaatgcgggagagcgctttgtcctcgcgttatgttacattaccggacgcccttcctctctctcgcacgcacgaggccggcatgcaggcaggtactccgtactccgtactccatagtccatacccacattctcgaacgagaccctgctgaatcgtgatccaagcccatcagatttcagtcgcacacctccttgcgcagtgtgccctctcaaccctgtcgtcgacggcagtaaacaattccgtacctccctccaactcggatcgtcgtttctgccgcgtacccctgatccaggctagcagacggggagaaccgaggctgaatttgcagtctctgtttattacactactacggagtacggagtactgaatccatcgccccggtcttgtccgaacggtacgtttttgaagcggaatcatagccttagatcagcaagcacatctggcaccttggcaatagcggcgcctagtcagatctcttagccccatttagctgctttttcacatgaatcttgcagacagtctatattcatccctgcttccctgattcatactcatattctgcaattcatacattttctaccgtatgtgacgtctgtgatgttctgagatattgtggagcgccattgatctttgttattgatgttgcgaatagagagccttccatggacaggtacctaattaacccgcgcagtcttattagggatagcatagcactgagcccggtatgcaggacatagcgtaaagcggcgccatggcacctcacgctggaaagattaccaatgctaggattatcaacccgtatgctcacaccttgtgacaccagcctgattgtccagatctcgaattacaacgtcatactgatagctcttgtgattttctgtccttccagggtcctgcgtgcttatgtacttggctatttgacttcaacgaccccgaggttgctctcttggttgtcgcgtcttcagagaaaggatgttgatagcaagcaaaaattcaaggaggtatggcctctaactcaccatggtcccttcaccggcaagaatagctgactcgaatttctcacagctggttcgagtcctcctgggaggctggggtctgaacagattcccaaccttctgcgctgccttggtaggtggcgccacgtggctgcctctattgtgctaccaagtctactcgatatttcgccaatggagttcgcaagcgtcgttgcggccatccagaggctttgtgcgcctcattcgcttcttttctgcctttatttctgcgtggataggattccagctacttaaccggaagcgtggtagccctcgtgctgatagtaccaccgagaatcatgattctcaaagacaaggagaggcgctgcccgcacatgacagcgatctggaaagattgaaacatcatgaacttgctgggagaaccttagacctgaccctcttttcgttcaccagggcgttggatgtggtcgcttgtattgcatgggatcgctggaagagccgacggaaatcccggaatcggtggacacgggtggaatcaatggctccgcaacttgcggatgctggtctttttgctggaagcgcagcagtggtgatgtgggcatggttctatctgcccgagagacttccgcgttcctatgcaaaatggattggagaggctgctcaggtcgactccagattgatcgaggcccttcgtcgcgccagaagaggagaattcgtatacggtaaagataccggccaagctccattgcttggatcaatgtgtgaggactacggctggccaattgaatggggcgatcccgccacaactattccgattccttgtgagatggtacacatgggatgcggcccgagctgtgaatggcatgcagcttctcgctttctacgaaccttcaagtttgctttggcgacgtatctccccctacatctccttctgcggttgcgttccaggcagtccccaactgcctgcattcgtgctgtcaaagatgcaatgcgatcttcgtcattcctcgctctctttgtgagcattttctattattctgtctgcctggcgcgtacaagattagggccaaggctcttcgacgcgaaaacggtgacgccgatgatgtgggactcaggcctatgtgtcggcgcaggatgcctaatgtgcggctggagtatattggctgagagtgcccacaggagacaagagattgctttcttcgtagcacctcgagctgcagcaactttgttacctcggcggtatgataagaaggtatgtgttgctcagtccgaccctcgatgcaactctgtaccactagggctagcaaaccagagttctagcccaagcctgcttcacgttcattgttttcgaatgcctgtcgaggcatgctgcgggacctgtatcactaacacctgtttgcagtatcaatggcgggaacagtttgcctttgctcttagtgcagcaattgtccttacctgtattaaggaacgaccggaaatggttcggggcgtctttggcagagtgcttgccagcgttatggggtaggtttatgagacgcttattcatccttagaatctctcaggcacttcgaagcttccggtgagaaggagggcctctattttgagtaacatcaacccccaaaggtgcgcgcaagattacttgatggactacaacacgatatagaatctgattgatgcatttttggtttgggatggatttattatagaagatgccgtgcagagctcatgtggtggggagcatactttgaatgattatgtagtttacttggtgtattattaatggtttattggccttataactgcgagtaatagaaatacaaattgaatatcaattgcttaaccataccgatgcagcttaagccaagaaagagcgcattccttagacatcataatagtttcaaagtggccgcatcatcctataggagattgaaaaggagacaaaaaagaacccggaacaagccaattgggcattttctcacctgagttctttggcctgcacattctttggcgtaactagccactattttctattaccttttttgagggcgtgcagtgtagaagcattaacgggagtccatcccttttgctatttacaaaatctcgaagttgatttgcggcaagcgccggacgggagtaatccacttccaaggccgccaagacacatcacgtggttgcgagcctgcctcgagctccccgaacttacgatcatgcttctcagtgacagtaatggtgagattttcagactgaatttggtctcttgaaatatggtagttcgtctggcccggtcaacagggcgatgtctctcatgctgggacatttaccatctccagcgattaacgggtaatgcccgctctcaaggattccagagatggttttcacaacagccgtctttgcggcagcagatcccgtcaacaccatatagcagcccagagtctgtcaaaagaaacaaatccaccctgtaagtatttgatgatggctttattttgtatctaaaagcggaaccttgtaccaattggtcctagatattacacaatcagtgtcatcgtgggcaccgttgcgcttgcatatggatctgtcccgttctacaagatggttagcacatactgctcctgcccaagtatttctcccatgaaggactcgactgacttgattatatggtatagatttgccagcagactggctggggcggtcaacctattcaaactcatctcactggcgatggtgatacagcttcacgtttaaaacctgtaacggacgctcgccgcattcgcgttaccttcaatggctcggtatcagacgttttgccatggaagtttacaccacagcagcgggaagttcgcgtgcttccaggcgagacggcgctggcattctataccgcgacaaacaatggaccaacagatatcatcggtgttgcaacctatagcgtgactccggctcaagtggcaccatatttcagtaaaatacaatgcttctgtttcgaggagcagaagctgaatgctggcgagtctgtggacatgccggtcttctttttcatcgatccggacttcgtaaaggacccaaacatgaagggcattgacaccattacgttgtcctataccttcttcagtaagcaaaatgaccccggatattgtgtttgatatagatgctgatagggacgataacagaagcacgatatgacgataacggcgtcctacgacctacaccctctgggtgaggatgttccaacccctcaacaaattcccgagcataatcggcgtcccagttcatatcaaatatgtaatgtactactgtatgaaatggacatcaagctagacttttctccactctctaagatgagcggcttaagcagcaggcatcggaaatctgggatctggaatcattcccaccagggcagctgctgtactagcaccgcttgcggatgaccacttgaatgtactgtatataactggagaacaacccgtcgaataaaatatcggcgatttctgcaaagagatgcatggatagtagaaaccatatactcaagctaaggtttctagatatgaatttgtactcaaatgatggggacacccatctgaaccacttttcgtattcaagcaaaggaagctccggaacagcggatacaccgccctcagatctcgtgcacgggccatcatttaagtgcggcgcgtctcgacgcgttactacgccaaaagttccgaatgcctctactccatagcttatgactgagtaggtataactcaaggtgctcctcaaaaacctatacagctgatctcagtgctttgccaccaataagcctgcacaatggctctcctggtggacaagttgcggcctaggacccttgattctctttcttatcaccatgagctctcagcgcgattgaagtcactggtgcgccgctgatccatcgcacgtattctatttgagaagcttgcgctcacttttactccttggtacaggctcagagtggcgatttccctcaccttctggtttacgggccctcgggtgcgggcaagaagactcgcgtaatagcaacacttaaggaactatacgggcctggagtggagaagatcaagatcgacgctcgcgtattccagacaaccagcaaccgaagcttgagttcaacattgtctcttcagtctaccaccttgagattacgccggcggacgtggggaattatgatcgcgtggttatacaggagctgctcaaagaggtcgcccaaactcagcaggttgacctttccgcgaaacagcgcttcaaggttgttgtgatcaacgaagccgaccatctgacgcgcgatgcgcaagccgccttgaggcggacgatggagaagtacagtccaaatttgaggttgatattactggcaaacagcacgtcaaatatcatcgcccctatccgctcccggaccctgctggtcagggtctcagcgccgacggaagaggaaatttgttcggttttgaggatggctggtaagagagaagggtgggctgaagtggatgggctcaataaaagaatcgcgaaggagagtgggcggaatttgcggcgggcattactcatgttcgaggccgtctacgcacaaaagtacgtttttgcatccatttctacaaagtctcacgctaatgacatgcgcatgtagtgagaaagtcaccgacaaaactccaattcctcctcctgactgggaggctctcatctcactgacagcagatgagatattagcagagcggtcaccggcacggctattacaggtccgcgcaagactctacgacctcttgactcattgcatacctcctacaaccatcctcaaggtatggaattatgcgtggtttcatgcaggcttagagctaacttagattcagacgttgacgttcaaactaattgctaaagtcgatgatgctctaaaaccagacgtaatcaaatggtctgctttctacgaacacagaataaaactcgggagtgtgagtgatggagcagcattatgacttctaaaacgctactctaaccttcacctacagaaagtcatcttccacctagaggcctttgtcgccaagtttatgcgtatctatgaagggtttgtcttccatctgacacatcttgagagctgatcacaaactaatctttgctgccaggtacttgatgggaatggacttttaattcggaagaagggcatcgtgaaaaacgcgttatgagtgtggtaatggcgcaaaaaaaaaatcatgtaaagcatggattcaatcggcgaaatggggtttttgattctgcatgggaactttgtatttcttgtctcggttgtactatatataatctggagctagcaaataagacgccccagatttgtcttttgagtataataattcgaaaggccacactggttcctgatgtcttttgtgttcttcgctggctgagaggtataggttacgtcatcgtacccaagtacatcatcgatatgtccacaggtacacagccctgctgaacctgcaattcggagaaagaaataaaaaaattcttagaaaaatactagtacttcatcgaattgcagaccaattgcatcctcaatcgaactgtgtcgatcaacgcacttatcattattatgtctcctgaactcaccgacctggagcctggaggagagagttcccagtgagtagtagccccccgtattctcatttatctctttgttttacgaccgtacatgccttatttcgtatctttaaaatgtttctagaatgagaagcagctactcgggatcgttcagttctaattgtgatattggcgttaggtacgaatccattcgcacagtcacagtgtcacccgctaaggagagggggcaactcggaggtaggcgtgatgtttcatcggttttttttttgtctaatggctaatcagggacggttgttcaaatgcagccaatgagaagcacacggtcagcgagatgaagatactgtcagattataatcgaggaaatgagacgcttgacagagactcaactgtggaacccgcttttgcggggacaactaccaatatctcaggtcaggttaacaaaggtatatttgataatataagcagctttccttttgtttcatgctattcctgatatggacaccgttgcaccgcaaaataacacaaaatgacgctaatgttattgtacataagatctgaaccctgagtcgcagggaaacgatgaagaaacgaggcgaagtaggacggcacaaagatacgggcccggctcaggggtcggtgcatagattgcctctcgaattcatcttccgatgacgagcccgttcggtagaagcttgcctaatttattgagcaggagacgtgctggaagaggcggtttgtgacgaggcggttgaattcgaggtggttgaattcgagttggctgaattcggcatggggagaggtactgctctgcgcggtttcttgaggctctccaacgtgacgccattgcccaattttgttataccaacgactggcggatcacccttcttcacaaactcccacagccctacaaatttcaaatcagcgtaccattccgtcattcccaatgagaatattggacataccaggcagtttgtgagcagccaatctgaatgcttcccgagccactttttcgtgcaagtcacccttcagttcaaaaacaatcctactgacaggaattcttgccgcccagtagtcgaattttccctttcctttacccattcgcatctcatttcctttcgtatagacgccgatgttggcgctgactctcgtatacagcttgtagttcattcctcgtaatcgctgcttgatcgtctccgcgccgagctttagctgagctgcagacactcgccggtcatggtccttcatacgcaggccgtagtcaccccaaacaacggtagtacctcgagtcgagccaccggtgtgcatcctcgggcgacccttgggagactttgacttctccatgtactttggagtaagccagtccagagctggtgacgtcgttgaaaaacatcgcgcaaacggtgagaagtatgcaaaagagggcgctgagtctataacacaaggtaagtcaatatgagtatgggagttgacatccagctaggaaaaaagagtagcactcacacgagggcctcagaaggcccaattgaggcttagcaaacatcttcaactttgaatatttcacacagggacatgtgaatcctcagctgaagagaacgtaagctgcaccttgcttatcgtatgaatctgccgcttgtcgttgcgggaatgttcggggatgtccaaaaggagcaaaagaggctcattcacgtgacccacatgcgtatattatgtaatcatgatgctggcttcgcgatgcgcgtctccccgcgaatggacgtgtttcccaaatctggagagctggtaggcagcacgagctcctgggccgtgatatctgttttaaccagctgccctacctctttttttgtctattttcgttttgttagatagggctatatggttcaaaaatcagaatgcccgttgacataaggaactttttcggtcctaagagcagccaggactcccatgggtcggctgcgaagaccccggcaaagaaagaggtgcgtgaaggtctaatttatctgccacgctcgtggaatctcattgtttaagtctgaacatttgatttctggtctatccaagttgtgcccaagttgctaaattgcccttgttgcaagaactcaattttgctaattacaaatgatttatccaggatccatccactgcccggaagagacgtaagagaatgtgaatccttcatatctatactttaatctgacacaattaatattataggcagcagaaaggtgattgatgacagtgaggatgaggaagtcgaaaatactaagacgccaccggccaaagtcataggaacaaagcaagagtaaggaccttcacgagttcatcggtggtcgtgcaatactgactcatggggtgcaggaagaaggaagagacaaaaggcgaacccaccactacgtccgagtatttttcgtctagcaagaaaagagggcgaccgccaaaaaagcagagcgagaaaaatgatggcaagccaccggtcaacaagaccactaacggaagtggcgagaagggtacgcctaaggcgaagcaagccaaggagccatctttggctaggaacgaggaaaagccgggggatacaaaggatacaccctacctgattgaggacgatgaggatcttggtggggatgatatctttgccgccgaatacggaaagtctggtcgagccgacgatgactatgttgaggagaaaagtggaaatgattctgatgacctcattgtacggcctcctgtggcggcatctgggaagcaagagaaaaagcaaactgctgtacaagacgatgaagacgtggaaatggatgacgccccagaagctccagcagcaagacgtggaagaaaacggaagtcagaagctcttttggacaaagacgaggatggaaaatcgcgtgatgtcaagaaaggtgcagacacacagacttcgtccgcacccaaaaaacaaaaggccactccttcgaaaaatgatcggccagagagtaaagagatccaggacattcttgacagcattccaactgtgaaaccaccttcgccgcctccagactctgatgagaagaagaaattcaacttcgcagcccaggcccaacgatcgcgtgatccccctgctgctggaacaaaggaaatacctgttggtgcaccaaattgtctggctggattatcatttgtgttcacgggaattctggatacattaggccgcgaagaagggcaggccctcgtcaagcgctatggaggaaaggtcactactgcccccagttccaagacgagttacgttgttctaggaaacgatgctggccccaaaaagctcaaaactattcgagactacaacattaagacaatcaacgaggacggtctctttgaactgatcagaaaacttcctgccaatggtggtaatggcaaggctgctgaacaatacgaggccaaaaggaaagctgaggagcagaaggtccgagctatggctgcggagatagaggaggaagagaagaagagatcacaggccaacgctgttcagacaaaaagttctcagccaccttcaagctctcaggcacccaaggtggatgaccgtctgtggacgacgaaatacgcgccgacatcccttaatatgctctgtggtaacaaaggccaagtggaaaaacttcagacctggttgcgcaactggcgaaggaatgccaaagcgaacttcaagttgcccggaaaggatgggtccggtctttatcgggcagtcatgattcatgggccaccagggattggcaaaacaactgcagcacatcttgttgcaaaacttgagggctatgacgtggtggagaccaacgccagcgacacaaggaacaagaaactgctagaaactgggcttcttggtgtcttggatacgacgtctcttcaaggctacttttctggagaagggaagaaagtcgagactgagaagaagaatctcgtgctcataatggacgaagtcgatggtatgtcggctggtgatcgaggcggcgtcggagctttagccgccgttgcgaagaagactcgagttccgctcattctgatatgtaacgaccgaaggcttcctaagatgaagccattcgatcacgtcacatatgagctcccctttaagcggccaactgctgatcagattcgagcgagactttctacgatttgcttcagagagggtttgaaaattcctccgcaggtcctcgacagcctaatcgaaggcacgcatgccgacattcggcaggtcatcaatatgctggccactgtgaagttggatcaacaacagctggattacgataaaggaaaagagatgtccaaagcttgggagaagcacgttattttgaaaccttgggacatcgtgagccagatattgagtgctcagatgttctcaccaagttccaaatccactctgaacgataagatcgaactctacttcaatgatcatgaattcagctatcttatgcttcaagaaaattacttgaagaccaatccgacacttgctagtggatattcgggaaaagaacggagtctgaagctccttgagcttgcagaaaacgcagctgcaagcatcagtgatggtgatctggtcgatcgaatgatccacggcagccaacagcaatggagtttgatgccgactcatgctgccttcagctttgttcgaccagccagcttcatatacggaaacctgatagatcgaccagcatttactaattggcttggacagaatagcaagcaaggtaacgtttcttttattacatggaaatgatacccttggctaacttagactgcaggaaaactcagtcgttatgtgaaagaaatacagggccatatgcggctccgagcatccggcgaccgagatgagatcagacagcagtacttacctcttctatgggacaagctcattcgcagattaatggacgacggtaaggacagcgttgaagatgttattgatctcatggacagctacttcctcactcgcgaggattgggatgctatggttgagctcggcgttggtcccatggacgagtccaatgtcaaactcgaatcccagacgaaagcgactttcacacgtctttacaatcagcgttcgcaccctgttcccttcatgaaggctagtaccgtgctggcaccaaagaagcttcccaaggtgaaacctgatatcgaggatgccatcgacgaatcagatgaagaagaggaggttctggatgccgaagtcgaagacgaaagtgaagagttggacttgaaaaaggacaagtacatcaaggttccaaagaagccagcagcccagaaaggaactgccgggaaaggcaaaaaggcctccaagggaaagaaggacgatgaagacgacttcatcgatgatgacgaagatgagaagccgaagaaagggcgtggccgcaaggccaaaggcaaagattaagggtgaagggtttggatgctgtggactattctgcctcgacagcttgcattcgttattacgtccgttcagaggtaacgaggacttctgtatactagcgcaaagcagtagggacatttttgtgtgtttggttggcgttcttgaactcggatgggttgtatgtctaatgaaaatggtaatcggcattaactgaaaataatttatttcgtgcagtacatggatttttcctctgactcccgagtaagcgatgagacagttacctgtcgatattcaaacgtagaggtatcaccagttattgtccgtccacgcaacccgcgtcagaaatttggccaatgtccagcttggtaagcagcatggaaggttggaaatatactactccatgagacccgataacagtttattccgaatgaatgacaaatcagctagcattgattaagatgagtactctgtatggtcggttatttcgagatattactccgtagattccataatatagtcacagacttagtctttgatcatcttccacgtggccggggtcagttccagagatacaggtgggaaagaaagagatccagccaaccattattttaaagtcactgtacatcagtctgataaacaagacagactgtttctcagtgactgctgttgatggctggtgacgcatggagtctgtggcgagtgaactaatcattagaccttccccgcgagtggggacatgcattaacgcattattcgatccgactccgctccgcctccctcatcacagccggtccttgttgtcggctgctgtccacgcctcgaacccttactgctgcagagtcctttctacattcctttctccaggctggccctgttccatcactagaccattattcacactcattgaaattcatatgtcgtgaattgttaccgcatgcaaccgtggcacctgcccagtaaccatgcagttcatggcctaagttaactcgttgcctcctcccaacgcgtcctctttcgactctcacgtaatacctgtgcacttgtatcggcagagggtgagcgctttttggatttccgcgggtttgctgtggggttttcaggatgtctctcctgcagaatgaagagtaagcgctcacaaccccccacgcttccctgtacagcgaacaactactttgagaatccaggacgcgtgaatgtctctgacacatttctagcttcacaatctggcagctgcgtacctcatacctttcagtcatcaaggatggtataggcgatcgccttatcaacgtgaacaactctgtgctcaacacccccggttttcgcgccgctggctggtcgcccgctgtgacaaatgcagcagcacaggatggcatcaagcgtacttactctccgccaattccgacgacggctacagtggcatccgagtattaccgcctcgcgagatacgcgcatagggaagcgagcgacggcgatggactgggaatcggggaggatggagacgaggatgaggggggtatggtaacaggtggtggggggagtacatacacattcgggacaagacatcatggcagaggtgcgcgcagaaatcggcgacgcgaacgccagcagaatgaacaaagacagggtgagggagaggatgaggatagcagcgaccttagtgacgaaagcgatgaagatggggagtttacgcagaggtaagttgtggaggccaatattcccattttccctctgtccatttcctttgtaatccgtgcttacattctatccagagctgcacagcagatcaagttcgcaaaaatgccgataaggcatcgagcagggtcctctccaattcgatcttcagatcgtcgcgatgggccggaagtgactgtgacatcaccatctcgcgcatcacctgacaatcgttttcggcgaagttcgctgggtgcagtggaggtgatgaaagtgcgatctcggggcgatacaactacgagcagtgatctatccgacggcgaaatggacccgtctcttttcaaacgacgcacgattcaattctcatccgagcatcaggtcatcgaggagccagcaaaccaagagcctgaaagcactaacaaggccagtgctgagaacagcgaagcgactgctggagaaatgcatgagcaggaagaagattttggaggggaatcgcccgactccgtgctctcctctgattttggggctactgctggctctacctccctacttgcagatgtcgatatgaatggcaccttggattcgtcacccatcatgatgcacaagctacctaatgcgggtagcacgcagagtgcttcgcccaagaagccaaaaacctctgcccctactttgcaggaccttcctccgccgcgacctatcagtaccgtacaaccagtgagtctgttatccaaggaactcaatgcccgaaagaaagttcccagcaatcctgtggagaaatttgcctcgctatgggccaatggctcgactacggcattgaatgtaaagatatacgccccgttctccacccaaccagataaaccgtttgatctgccaattttccgcgagttcaaagatgaagatcactcgggaccagtcactgttgcggacgctatcgggctgagtctgtggagatacatcaaggaaggtctcaagcccccgattgaaggcgagaaattgaacgtcaaccgttggactttgcgaatggttgaagacggcgaggtcgaatatgatttccctcctctgggtcgaaatctgccgttggccgatttcacctcgaacaataatcgagccgccgcgcttcgagggcggataagaggtaaaccctacgatgaattcgcgctggtcgaagccacacaggccgaattcgaggagaatgaacgtctttaccccaaattcagtacagggcaatccgaagagagcggcgagcaagcatcagcggcggcgaatacgcagcagccaactgcggcgccgcaaaataagccgacgacgaggctcaatcctatcctcaaccaaccgttctcctctgcgctgaatgacagctcgttgactccggctgaccggccagcggttcccacatcccatgccactccccggatgggagtctccaagacattaaaggtccggtttatcaattcggatggctcgagccaaatgacgaccgtcaacacgtccactgacagctacatcgccgagatccttgattccgtctgcaagagatggggcttggacaagggtaattaccttctcaaggtcatgggttccaataccgtggcgccattggaccgcacggtggaggcactgggcagcgtgacggagctggacgtcgtccgccggcggtttggcgcaggctcgtcactgacagggtcgcccggcagctcttctcccaacgcgcctcttttgattgacaactcgaacaatgcgaactcgaagaaaggcaagaaggggcatcaaatgcttcacccccttgcgcagaagcaggacttggtcggcggctattaccgtcgttattatgtcttccgcaaacaatccatgtcctttacgacttcgaaccagcgcgttttggtgcttgacaatgactatctacatatcatgccggccgactctggcaaaggggtttttgagcacacggggaagactcgatcgatcagtttcaatgatatcgtgggatccaaggtgagccggcggcatcccaagagcttccgggtcgtcgtccttcgcggcaacgaggccaacgagcagaaacggtacgatttcgaggctcgaaacgaagtggaggcggtggagattgtggatgagatcaagaagaacatggcccattatcggatctagtccatcctctttcttttcccgtctgcccatgatcttcagaatgatgcggtcggcctctttctgtccaagtgtatgaccattttcttgtcgcgacttgcatgtaaagatgtactactggctattctgttttgcgcatgggcattcttcttctggaacccggaacaggaacagagaggtataggcagatcattatgtaacattgattgattgctgtagctagtttgctctgcagacaaagtcttcgactattcttacgttcttaatttgtgctgtaacgatgggattacccttgatgattgcagttgaaagaaataccgggcgtaccagggctgatggggccggagacaaagaaacggcatgggggcggaagctgctggaaagtcgattcattattattattcttcactcagctattcgccatccacccttattgtggtcgtttgctctatatttattgtagcacatcatcaccattcatagtctcttcagtcaagacgaaatagacgcgaaatgacgagcagtatcccagtaggggcattattagcttgcaactctgtacactgaccagtgttctgctgctaaataggcaggacaagaagaatagtagtaatagtagactgttattattgtgctattcaatactacgtcaatccactccttgtgtgcccgattgttgccgcctctccaaaggcctgccacctactgcgtactcatttcattcaattcaccaaccaccctctttcttttcctccaagaacgaccttatttcctgggagatccagcctacctacggggtacagacctatgtagctagatcccttgcatcgtttttggcccttcttgagtccttcacagcagggctggttcggccccctcgccgcggcggtctcgatgcttggaagttggtggctgacctcaccagtcgagacaggaatccagcccactgggcagaccccgcaagcccccaattccggaactggctgcaacgctcttcgtgacccaacctccagcctctctgtcgtttctgtctgcgtcttgcggcctcaaatctcgacgatcaaagctcgctgatctgctgttccgggccgtttgatggatattattaggcgcggagcagctccgttatcgataccgccatcgcacacgccgaccccgtcaccccctcgacccttttaactccgaccccgctccctgacctcatcgattcctggacgacagcatcgccaaacagtcaaacgtcgtacggaccaattctcatccgaggcgcttcgatctgctacgccggactactgcggagaaccgctgattgaacctcccaaattacgtagccgccatttctacaacggtgccgttgtggccgaagatcactcccaccactcaattgtccttcgtcatccctccaagtcgcagtttcagactcttctgcggtctgaaaccccctcgagcagctcatgccgacgctaggaggattgttgaagaagaaaaagaattcctcggccgcttctaaggacttcaattcacccacatcgcctactattgccgaagcatcaacggacaagcctgcagcagtcgaccacgcccaaacgtcagcgtcacagacgtctgagaaaccagcgcacgataaccactactcctcgacgaatgcaagcgggggtaacacgtcggagacccgatgaactcggctgcactgcaggcgcaccaccacattccgaccccaagccacccctcgcaggaccagcagcagcaccagcagcagcaccaacagcatcaaaatgtcgccagcataaacaacatcatcaaccctccccatcaaggggaggcaggccaggccctgggccagcagctgatgcagcaacagacagtcaagacgcaaccccggcagacgaaagggaaatattcattggacgatttcataattcagcgcactctcgggacgggcagttttggtcgagtgcatctggtgcagtcgaggcataatcaccgcttttatgcaatcaaagtgttgaaaaaggcccaagtggtcaaaatgaaacaggtcgaacataccaacgatgagcggcggatgctgcaacgggtcaaacatccgtttctggtcaccctttgggggacatttcaggattcaaagaacctctacatggtgatggactttgtcgaggggggagagctgttcagtttgcttcgcaaatcgcaagtacgaaaacccctctctactatgtctgggactctttgttcaatgaagattgactgctgttctagcgatttccgaacccggttgcgaaattctatgcagctgaagtgacactggctctcgaatacctacattcacaacagatcatctatcgtgaccttaagccagagaatcttctgctagaccgccatggccatctgaaaattaccgactttggctttgcgaaagaagttccggatatcacctggacactctgcggaacgcccgattacctggcaccggaagtggtctcatccaaaggctacaacaagtcggttgactggtaagattcccgtatccaatatgtgcatagagaggatacgcctgttaatgaggtgtcaaaaaaaggtggtcgttgggaattctcattttcgagatgctctgtggattcactccgttttgggatagcggttcgccagtcaagatctacgagaatattttgcgaggaaagatcaaatatccgccttacatgcatccggacgctgtagatctgttgtcccagctcatcacaccagatctcacgaaacgattagggaatctgcatgggggatctgaagacgtgaaaagacatccttggttcgccgaagtaacgtgggatcgactcctgaggaaggatattgacgcgccgtacgtgcctcctgtgagggctggtatgggcgatgccagtcaattcgataggtatcctgaggaccatgagccatatggatgcactggtgaagatccgtaagtttctgttcatgatcctcggtcctcactcgctagataacgttgactgatgtctctctcacactctctcacagatatgccgacttattcagcgaattttgagaatcagccgcatgaattacgagatcatgaatggcttgcgccatacgaagtcagctactgcatgctatgctggcgcagtgcccatagcaattctcggactagtatttctatcaactgcatgatccttttattgcttcttcttctccctcttttttatttatttcaattatttttttatttcctgtagttacgctggcgtatttgagttatttgcgaagatatctcataaggatatcttactcagtcgccagtcgactgatctatctcaattatttttttcaaacagccctgaggaatgggttgttaggatctgggtccggatttgggaaaaatttctctacttgtcaacggcttatctgattcttgttttttttatgactggcttagaagatgcgaggccgcgaaagatgacaatttccgactgtagacaaggcccctttttgacgacttttttttgttacttattttgctcgtcattttctttctttctacatttcaaataagccttttcttgggttcagatatttttttttaccatatgttttcttcattttggtcggccatttcccctttgtcctattctattctttcttcggtattgcgggttctggttcaagtaggtggcggcttcttgaagaaaaaaaaaagatcttgttgatttattttgaacagaagctgcctgcctagcgtctggttagggactgaagattatcgcagatcatcctcttgtatgcgcctggttttgtgggctaactactgtcttgacatacttgatgtgttaagacttgtcaacgtttctgttgctgtagaaaactgtgaatgaatacatatacttattgacatatcaagccctagtctggcatatcatgaggagcatttattgccagagtcgtatctttgcacttattgtcgcttgcaatattcaattgccggcggaccttcaagttgcgatcgcaccctgttttctctttccccaaacgcaaattcttaaacaaggaaatatgggagtttgacattggataatatatatatcatatattgagtgagttgtgtgtggacgttcatctttctatcgcaagtccttttattatggaccatgccaacttttggttttgtttgttgagaatgaaaagcaaacattaaccgatggttattagcccatggcctccccaatgttatacacaaatagtcatacaagtctctgaaatgatacaataagccggcccaagctatcctaaggacgagagatagccatatccgagtcatcccgatgcgccttagacattggcccttcgttcgttcgtttgttttcttcataatccccgttgagatgatggtcgttcatcttagcttgacggcgtacccaaggaggccagggtcccggcatccactccaccgcccatcttcttgctctccctgccgatgcgcgcgatgtatgcccggctggtggtgttccacatcgagatgtacttctccatgcacgtcgacagacacgtggactcctgcgaggagagcgaggagcctgggttcgggatgcatcggtcgaagcagttctcgttcattttctgcaggacgtttaaccgttagatcagaacgggctagaaacctggactccatggactaggtattcgtacggtcatcagggcccgggcgttgttcagggcagcctcagcctgcacctgctgcatgagggccgacttcagctccgcggaggtagcatcggacgatgcggagttcccggaggaggaggacgaagaggaagagctaccgccgaagagaggcatggttggtagtgttgtgggagagacacagacgggagaaagctgggaagttgttcaaaatgacaagaggaatatctgcgaaggtcgacggtgcaatacaattgccaggccgccagccaatgaatgaattgagcgttggaagttgaaaataaaagttgcgggcgaaagatctgcggagttaatcctgtggctggacggctagcgctgcgccacagcatgtcagatgtggacacttggatacatctacagctacgactgcatctcgaaacgacaccttgcccttcccgtccttcctttccctcgaggcccggcgagaataatgtccgggagctgatgcttcagtggcacaagatcaacgcctggccgtcttagtttcttttcttcttctctctgaaatcattcccgttttgccgctgtttaccttacctggcccgcgcgagccctttccttgtctgtcttctgtattgtatactctcgtcggtttgacccccgccctcgcagttttttggttccattcgttcctttttttgagcgacaagtctatattcctttttattcagcgacgcaaaagactcgatatgtggctgccccaaatcacagcttatttgtgcttggcggtgttggccgccattgggcgtgccaatgcctatgagaaggatcccgatatcaaatccatccctgtgagtatattgggttcaatgcgttgctaaggagggaacctctttactgaaatgatattccttgcttcttggcctgatcagctgcggactcacagcctttctccggtacgaccatttccaagacccggtatttgcatgagagaatggttcaattaacagagggaatgcacagccatacttggactcggacatgcacagcagatggtgggatttcggcggtgataccatcatacgtacggacaagtatgttggtcgcaattgctcctgagtcggtcgtctgctgaacagacctctaggtatatccgcctaacctcgaaccggccttcccaacaagggtggatcttttctcgcattcccctcattgcgacgaattgggaggtgcgtacgcacatggatttggccttctgggaagctgacagtcgttagatcgaggttgagttcaaactccatggcacggggcacttgcatggagacggctttgccatctggctcacgaaagagcgcgccacccagggccccgtttttgggtcgacagacaagtttgagggctttggaatcttcttcgacacgtacaagaataatcgaccgggcgttgcgtttccgtacgtgatgatcatgaggggtgacggtcagacgagctacgaccaggagcacgatggaaaggcgaatgaaattgccggctgttcggtacgttctattctattactcatgcgatttggtcaacggacctttctgactctccatacgctaggctcgcggtcttcgggacgcatcggttcctaccaaagcgcgcctgacctacttccaggacaaattcctcagtctcgacctccagtacaagactgatgggtcgtggacgaactgcttcacgctgaacgcgaacgagcataatatcgccctcccctcggttacgtacctcggcttgtccggtgaaacaggtgaggtcagtgacaaccaggacatcatctcggtcacgacgaacaacctgtacagcgtcggcaacaatgcaggccgtggagataccggggcaggttccagtggccgtggccgcaagtcccacgagaagaaaggtggcagctggggctggttctttttcaaggtgtttatgttctttggtgctattgggggcgcatatgtcgggtacaccatctaccggacgagcaagcggtcgtcgagattctgaagttggagtttcatcatcatttgtctggtttcatatattccatccatccgcatctgttttctagcgttgtgcttgccttgttgttcatccctcatagtcacgaagtctttgcaagataagaaaaagtgatgatatgattgaatagccttgttttcttttctctgtcttacgagtaatcatcaaaccaagcagtcgctgcagttttgttgcggaaaagcataatgaagaattagcatatgaagtagacagaataaaaaaacaaaggaggtttttactagtttactagtcaatctacttagttgtctgtgacagtttcctttattagcttgtcaggtaacagaactgaatcccctcacttttaccagcatataagacctcagctgacctacgaagtattagtagccagaatggtgaaaatcctcacttttacccgacccattattgataggtatgcagggacatgatgaggtaggtgatcctgaaaggtattactgcatactaggtaactatataggtagtaagtgacctaagcataataaccctaataaccctgttcttaatattgataatttgattatactaaccccagtaaccttgatactaatttattatttatttattcattcattcctcgtttattctctggagagatgctttctgttaagtcaaatggaaatagaagaccatctctccttgatgcattcaagttaagaaagaaatgtttaactgcaggggtatcataaacatctgtaatctatgataatcataccataccatactaatcccatcccaaccgtagcgccgaaatgtcacttcttgactgcaccatgaacctgtataacccttgtaattagtagtaaacaaacaaacgagaaaaatcaaccagagccggcttttgagcgattatcgatgatgatcgatgataattagggtctatgtcttgtcccgccctgccttcgccctctcctcgctccacaactgatccaagatctgaaaaacctccgtgacactgcgcatcaaggtcggttcatcgctcagtcctagagacccgtaccgatgaagcatcttatcgggatgccagcgcacacgctcggttttgagcgtggcgacgatgtctgcgtgtccagaggcggcagcagcagcaggggcatggcgcataaactccgccacggcctcgcgtgagatgtcccgtcttttcccggactcgacaggccagaagaggtggttgcggaggataaacggcttctttttattctcgggaccgtcgccagcagcagcgctggtgccaggctcctccttggccgccaccgcagcattgagctcttcccagcttcgctgatactcctcccatgcggccttccaggccttggctcgtcttctctcctccccacgtctcagactctcctctatcgctcgttcgaatttcagttgttcttcagctcgtcgtcgctcggcctccgctcgcctcttctccttctccttttcccttcgaagacgctcccgctcttccatcatgccttcgtgcgttcgctcccacattcgggcccgtacgtactccgcgtactcctcgtctgtcatgcgctcgagctcgccgttggggcccttgggcacggacggtatcgcgtatgtgtggataggctgtccatagatcgattcccagaatgcagcgccctcgtcgtctgccagggcgtcgaagagagactcgcggaaagcggtgtttggtgacagaggcggatcaaagggcggggatggcggcggggaggactcggtctttcgccgcttagaggagcggtggtgtccatggtggtggtgacggtgtcgacggtgatggtgatggtgactgtgacgatgctcatcataatctttgtccgaatgtctatgcgaagaagaagatggcgaaccgtcgcgcttcaatctggatttggacgatttgaagcggaacctgccatgccgcgaacgcgcatattcatcttgctcatcagtgtggctttctttggtcgcggatgaagtctgtggattgtcttctttcttgctgtgagtgctaccatttgtggcagtcgagtccattgttccaggctgctggcagactgctgttgcctttggagggaagctgtatcagtggtgcttagttgggagcgttggttgacgtcatgtttttctctgtctgaactgaactgcctgtgcaattaatgaattgactttgttttcaacgcgacttcacaagcagcagacgcgcacgactgaatgcttgattgattgattgattgataaactcgtggggcccgtgcgagatcccgtggcaaatgcgggattccgatcttcagctccaacgccgatgatataatttcattcagtcaagcaggaccacttcgcccacttccccgtccacatccacagccaccatggcgctcgtttcctactccgactctgagggttcggactcagagaaccagactcagaacagtcagccggtcgctgcaaagaaggagccatccaccgtctccgccgatacgttcaagccctccaaacctgcgcaaggcttctcgtcgctcgttgaccgcggaaacccccgcaagatccgtgtcgctctcccggaaatcaagccagaggatggaattaacgaagacgaagaaggtggccccgcacggaagaagcctaggacgaatggaggtggcgtgttctccggtttcaattccctacttcctccacctaagcgcaccgcacaaaatgcagcggcggcagcgaataaagatcaaaatggtcctgatgccactccaaaggtgttcagtctgaagacgggcgccactccagggttcgatcgccaggcagatgccgagatgcggcacgaccaggctctcaatgagagcacgggacctgttgctggtggaaacgaggacgacagtacaatacctaaacctgggagtcttcgggaagatggaggtaatgatgcgggactactaaaagacgaagactacaagaagaagggcaatgccatgatgtttaagccgctctccgtggcacgcaatccgaaaaagaaatcgccatcgacgattgcagcttcacgagctgcagatggagtggctcagaaaaaggaatcagcagcagcagcagcatcgacaggaccaacgccgtcctcttcatcaaacgccgcgcctgcagctcctccaaaaccaaaggtcagtctgttttcattctccagcgaagagacttctacgacgacccccgacaatgcccaagctccagtgcagtcttcgtccggggagtatgaatctttactctataacccttcggataccgacacagcacccggtcctcaaccggatccgtcatctcttgattcctcctacgagcaacaacaacatcaacaaacggtggccgaatcttcttctgcctccgcagcgcctcaatcccaaccaactctcgacactatcgccaacgacctcaatctctccagctcccagaaacgccagttactcggacggaatcccaacgcagccaaatcgcgcgttctcaccttcgaaggggacgccgagtacgccgcaaaccaggaaatgcacacacgggaggagattgctgcgcagcaacacaaccccgttcgtcccatcgctccaggaaagcacaccttgcgccagctggttcaggcagccagctcgcagcgcgaggctctggaagagagctttgcggcgggccggaggaacaagaaagaggcaggctcgaaatatggatggtgatggtgatgccgatagcgattgtgatttgatggatatggcacagctcggtggtctgccgagttttgttgtagtaatgatgtatacccatttcccagcatgttctcttaaattcttcactatgaagagtattgggagtaattcaaaagtttcttgcttgttccgtaatgttagaacttttagctattcgcacaacgtcctttcaataaagtatctaagagctatgcacctctgtgattctcacttttctgtcttatgcagatgttgtaaactgatactattacattgtataccaatatctatctaccaatatcgatccggtcgatatttaacaagaatggttccaggaaattcatctttgtattgggtatttacatatatacacattcttgatcgagttccatcccaaaaagaaccatgcatggcaaattctaatacataaaaaaaaccagaaatacatcatgcatatccaaaccatatacagagaagccactctagtctaacaaacccatcagagaaccagagagagcgagaaaaaaatcactttttttttcctttaggatgatacttcgacaacctcggcaaaccactgtttcaacgccatagccaataccgccggtaactcccgcacgtcgcgaacaatcagatagtaggaaaatggaaacccttccagataccgtttcattttcagcttcatctcgccggtcccgccgctgctgtagtctggctcgaagctcgcctgcgtgagatccatgatggagctgcctttcgccgcgtcgagaatgatgaagacgatcatgatgcgctcttcctgggcctggcggacgagtcgacgtatggtgtcgtggtcttcgcagatcccgtcggagatgatcagctccagctgccacaggtcggcgctggcgttacctgtcgaagagcgccgcgcgcgggcttcgcggaagagcgcaatcgagtcggcgaccagtttccgcacgttggtgcctgtctgctggtagctgaattgctggaagacctggaccccggcctcggaggagaaaggcttgccaaactcgtgcgcaacccggacgtgctcttcatcgccaaagcccacgatgcacagatcgccgacttccagcatgctgagactgcgcgcgaccagcgtgagcgtctcaaaggctagttgcccgctgccgctttccatcatggacttgctatcgtcaacggcaagcatgacctggtagtttcgcttggagggaatcgaccgccgcatccagatcttgtcccgcttgtactgcgatgcgatatacgggatgattctcttgatgttgagacgcttgccggtccggaagtcccctcgaagctttgtggcaagggttggggccagaatcaggcgaagctgctcagtcagggacagcgagaggtcatttgtagcagactcgtaatgagaccaaagcctcctagcctcttcgggtgaagtccgcggtgcgagggatgaggacagatggattgcagcaagatgcgagtcaacttcgtccaacgcttcattggtttgcagctgaccatccttttcattgtatggctcgccgatctgggcattgttcccggataaactcgtgcccgtttggtcattgacatcagtcggagcctcgttcatttgaacatcctctggtgcctcttggtccgccaacgcatctttgctgtcctcagagacatctggcaagcgctgttcatcagcagttgcggtttccgattccacggccttcttctggtctaatgcctttgcctgctcttcgctagcctgtcccagagcttgtgtatcagcgacatcgtcctcatcagctaagtgctcgaagtcggcatccgccatgtctgtatccggcggcagcgcctgagaatctttctccttcgaggaattcatgatttctcgctgacgacgatgccactgctcaaggacatctcctaatttcttgaaggcctgcgtctgaggatcttcttgctcctgctcgccagcgccaccggatgtatcgtcagccctctgtcgatcttgcccgtcttccgtagcaccattgggctgctccatctgggcgcctgcgtccttagaaccgccttgttgttgcgcatcaccagatgtgcccttttcctcattgatgtcctgatcagcaccagggccgccggacactgcttcactcggggcaacatcatttccgtcagcatcattatcgtcgcgctgggttcggaagatatcttgctgttcatcctcttcctcattagatggttcatcctccccaggcttctcggcctcattcccgtcatccgcttctgcagaatctccttcctcgtctccttccatattggcgtcctctgactgtgaagcagaatcgccgtcatccattgtctcatcttgagcttgttcggcttgtccttcatcgaggtctggccccagatcagaaagatcgtccattccatcatcttcgtccgatcccgcatcgtccttctcttcaccatccagctgcatctcctccggaaggtcaagagtctcttcttctttggcatgcggatcggtgacgtccatctcctctcgcccaacagcttcgccctcatcctcgggagcctcttcctcttcctcctcttcctcttcgttctcctgcgcttcaccctcttcttggttcttgcccttttgtttatcactggatgcaacttgttggtcagattcagatacacccttgccctcttcgttttcggtctctttctgctcttcattgtgagagccatcccacagtttctcatccaccgctccgggatcaagactgttaacactgcccacttcttcgtcgatctcatcgtcttcttcttctgagccactctcatcctggtcttctccttcttcttccttgtcatctccgtcctcatcatattcgccctcaagctcttcttgatccatgtcgacggcatcgcgagacttctccatatccttggtagattggtcaggatccttctgttgggcaagttcggtcaagtcttcatcatcctcaatgtctttactgatatcttcagcaccttccccttcgccgagtccggttccagcttctaatttaccagattggccctcctcgttcgattcttcagcggggctacagaagccttctgatgccacctgggtgaatgactttgcaagaacataggacatcttgcaaacctcccgatgaacggagaggaaacgacctattaagtcctcgcatatggcccgatgttgctccacgattggaagcaaacttgttataattgcagaggccaaagcaagtgcaggaccatgttcgttttgaagaaattggagtttgcccaggactgactcaaaagatatggcaatttccgaaatatgtagctccttgagggccttgcttaagacagaatcggcctgggcgagccaatctttgtcttccgtagaagacggcaaaccgccaagtgaactcttgacaccctggagagcaacaagaattttgtccactgctgacaggacctcattcttcaggtcgtcaagagtcaatttgctccccatctccgttgttgctgcactagtgtttgccttgaaatccgcccaggaagctatttgctcaagcacgaaggacaagtcaggacgttggttcttccagtttgtcacgttggcgctcagctcacgcaaagaatcagcagccttccccatgacatcggctgaagtttgtgaagagatgcctgctggaagctcaggaagaccggctaatgactccttcaagtggtagagacgatctttccatgcctgcaattcctgcaagatgtttgaggagtcggttgcagaatacttcgaatggatctctatgatttcgattcccactccgacaattggagccagccaggccacatgcctcatcagatcctgtttctcctcctttcgtgaaactttctcctggcagagagactgggtccagaggttcctcatcctcagcgacgtagacctaagagtttctacgtcacgaagagcgggagaaatagcgtctcgctgtttcctaatcaataagaggagaccttcggctgaacccacgctccttgttatctcgacagggttaagatcctcggaatagtctcgcgacgcttgtcggacacgagggaggaggtccaggaatctgtggaaatacaagtctgcgcttttcgctttatcagacccagagacattgtcgcatgacagatttgaggtggtcgcaaggacttgagagacagtggcctgttcttcttgaagaacagtgctgacattccgcttaacacccatagaatacagttgtcgtaaggtatccgcgtagaagcggcgtttttgcgccttgagatgttgcactgtctctttgttttcctcagttaaagtctttggggtctgagatttgagatcctggatggtttcaatagcatctgtcacaaaattatcaagctgcgaggcaatgtcaaactcggtcagcgagctgccgtaaacacgcgacatgttcatcgcggtggcctggggatctctgaatctgggagctctgctattccacgtcttgtcatgctgttggcacatagcaagagcctctgcagatgccgacgagctttctgaatgtgtcccgttcgtaacaggatgccctgcttcctgcaaatcaggcataccctgttgcaaaagtgtctcagtggactgggcaagcaactctctatatttccggataagcttgaagagcctgtggtgtgatcgttttgcgctttctctgagagcgataatgtttgtgtccttccagcttgcaagctgaatctgttctttgatttccttttcgagagactgtctaccctcctcgatagacttcgaaatgacagattcgaactgccgatagtgctgcaagaagttctcaagagcagcaactaaacggctcagaggtggagattcctttgcgtatagcagcaggagcgatttgaaggattccacgagccgtagacgagggctgaactgacccatggttgtcgacttgaagaaactttcgagagtggaaacagtctcttttgtataattcgtgatatcttctcccgtctctaccatctgcaagggaaccgccagtaacacctcgtatgcgatgaaccaccaggagctcgcgtcttcctcgcatttctcattttcaatgtccagtaactttgcccatgtcgccagttccaggcgcctccagctgatgatcagagctgtcaggtcgttgtactgagaggcggccgaatattccctgcttgccacaagctgccattcgtgaacgagggcatgaagcttttccaccttcgttagaaactttgcaactggctccacatgcctaaattgaagaacctcctggcagcagacaagaacatcgtggattgctgcatgttccggccagacagtttggagctgactgaaacgcgactgcaccgaaagaaccaacgagacaagcttctttgcttcggaaatgtttggatccgtgtagaaattatagcttcttgacggaacttgcccaaatttcttcatttcatcatcaagcgcaagaatgatacctggaagatgggcttgcggcggtagagctgttggggacgacttgttgtttgaccaaacagacccgagcagacgagccgaatcagtgatgagcgctcgtacccttgtttgtacatctccgggctcaaaaattgcggaatggagtcttgataatctaagagagacagacttcgggtcaatgcgcgaatcttccctttctccttcggcgccatcttcgtaagttgggaacagtttgcgaaactcagcttcgtccgcttcttcttcgtcctcgaaagagcctttgtaacgatataactgggacctctgagcctcttctttctgttcatgtcttagctgcgtcttccatagtcgatagaagaaatcgagtatgcggctcagagcgtgaaggccctcaggcgcgtgcagtgttgaaagatctgcgctatgtgccgccactaagactgagagttcctgaaattgtacatctgtagggactttcagagccaattcctcttttcttgtccctgaacttgacagcagatgctgcctgccaccaaggaatggggtcctgtcactaattgcttgtacggacgtgacatctaaggagctcgggaccgcgctcaagacaagtgaaattcccaggtccagcatttggagaaatcggctagcaagtactgtgatgtcgtcatatgacctgaagcttgaccggagacgctggcatatccgttgaatgttgtcatgcagaaggccgccatattcccgaaactctgcagctccataattgtctggtcttctgcccaaaacagagtttatcaaattggagaattcgccttgcagttgcattaattgagattggcttggccgggtgacaggaggagctgggggttctgatccgaggtcttgcagctccttctgtatcaaacggcgacgtaagttcacagactggccagagaactcaagttcaaatgccataatggccttgtccctagcagcaagctcagaaacttgctgagcataacgtctccgctgaataactaagccaagagacggatcgcatggtttgtcagggacgaaaaggcgcaggcaaatgactgccaattcgatggaaatacgaccaacttcatatacatttccatcagagtatgtccctctcatcgttaacgcctgtaagcacttcgagagacccccaacaaattccctgaagtaatggtcgcttgggagagactcgcttggcagaagttccgggactggtggaccgtcataccatcccttttcctcgacagtccggagggcatgcacagcaagctcaaagcgatctgagttcaaaaaatctctgtgcagctccatgatttccagacagactctcgaaaaggcccttagaagaagtctgatctgatcaagagcaatttcttgagaactcagcgctagggcttgggctagaacatgctcttcggtctccaggaattcaagccggccaagcgtcacgtcaccaacgaacgccaatctctccagtagagaaagagagaaattcccattccaaggagatacgatgtttggcagcgcttcacaaccattgtacgaggataatttttgcagcatatgcggaaccagagacccgagattagaggtatctgatgggcgcgctggccgacctgcgagtaacggtagagtgctattcagaatttggttatccatgtatctgttctgagaccagatggtcggcaagtcgtggtattgacagagtgtctcgaagacgccggagaaatgaggacgctgatccgggtcgtagaggttgatagcagaagcaagctcgctaacttgttgcttcaaggcctaatagcagtgagtatcagatttcgctagaagggatagaaattacctacctgcaccagaacattgccatctgctccgtttcgaagcactgaattctgcgcatcgattaaggaatttcgtacccgactaagttgacctaggtcaagccgcgcttggagagcaacagtagcgaagtgcgatacaaccccttcaagatcgatgagacacttcagttggtcgttgtcgacgcaggttatcggtcgccaggagtcccagattctctgcatgcttaatcctgtagtcaaagcccacgttgactgaaatctagcgaggaattgggcgaagaaggaagccagaggttctaagagaggtccttgatcgagtgcagaagagtggatatcctgaccaatttgaagataagtctgaaattccccctcatccatgtccttggcctgcgtagctgcaaagatatcccaacagaacctggtaatagctttcagagcagaaagagagccggaagataggggaattgtactatccagactttgaataaactggtggagagaccgactgcaatcaatcaggaacgaactgacaggctgtgttgagtctttcatcaaggccggtattctcccagaggccaatgaacgctccaatcgcgtcatttgagaaggcttgagatactgggaattttcattcgctcgagccatactctgttgcatatgatgcagactgagtttgagttcttgcaaacaggcgacgatactcagtttatctatagaagtcgctccaacaaaagccagcggctcgttgataagaggatgaacaagctgatcatttctgttagccagcaatttccattgagagttttcctccacgactgcgatgtatctggagatcgtaggaaggagattctccaacacaggtttatccgaatgacgtgaaacgaaatttcgaattgagtcttgaaatcgctccaggtccggcgttgctagatggtccagacaaagctcgaaggacacgtcgcggatatcttctgcaaccgtattttgattgaacttccagatattgcgtaggcggtacaagagagactgacaggtataggaaggtccaactgatcgaccatggtcgtccatggcgtgtggcaagaaacatatctcgacagatctgttccgcatagcacgagataactccccatttcgaggatccatcgttagaaatagcctgaaattgggatgaggtacgatcaccctcgcagagccatcttccgtcctctgctcgttcaaaacaaggtaaccgtttggctccattagggagttgaggcgatcaagaacggacgcgttacataagtttgcattgtcgagaaccacccaatagccacgttggatagcttcggtgagagcaccctcggtccattcgaagccgaccttattcgcatccttggacacttccaccaggacattgcaccgacggagaaagtcttcaacatctagatcagggtaactcgaccttagcatggtgattgaggagagcaatccgtccaaggagacatctgcattttggcaaagctgataaacttgaaggagattggatatcgattctgaagactctccggaacaaagagaggtgacaatgtggcgatgaagaaacaactccaagtccttggcaagcgacgagatctgtctccgatagtcaatctgctcaaagccgccgatcaaatccattgtgtcggtatcagcactcagagctaattcgactaattgagcgccattgatagctgcaagtttgcggagtatggttgttttgccacatccagctggtcctactagaatgcttggccatgctttctctatgcaaagaatgagtgactccagaatgggaagatcactcggggtaatcttcaactgtggttcatggagatgttgaagaacaagatctctctgcatgaatccacatccaacttggaaactatgcgtggtgagatcatgataataggatttatctggcggtggctctccaaatgttcgcttaaaaagttgggagatcaggagtcgatcctccgccgtgcggaatctctggctgatgatggtgtcaaggaaatggccagtaggaatctggacacgaccacgatcagctagttggagccatcttgtgatatcacggaggttgatttcccacggtccaccaacacttcctagctgtcggtcttgggcgatagtcgtgttcagcaatgaaatgaagtccacgagctttccagtttgttcgagagggctgcctggaaagagttttgcgcaaattttcttcaagtctgtgtcgctaaatgaatcggcgtacacgactgtaaagcgattgacaaacgaagcaggcaggccctttctgccgcctccctggtgatggggattttgggcggcaaaaagaacgaaatcaggatgtcgcttgaaggtctggtctagctcagcaacataaacctgttgtcgatggtccaggcaggaattcagtccctcgagcacagactgagaggccagattcatctcatccagcaatacccaatctccgcgttgcattgcctgcaggaatggtgcatctctccaagcaaactgtccgacatcaccgccttctactgggacgtccgacccaaatagatcagtgagatcggtttgctctgagaggttgatacgagtaagaggctttccaagtgctcgagctagagatgccaccaacgtggtttttccaacgccaggactaccttcgagaaggattggttttgatacttgtaaacctcgggcaattcgaacagaattagcgacagttgtaggggcatccatgacgaactgagggtcaggagcagattccgcacacatcgggagcttgaaagggcccacgcagagatatccgtcggtcaccgagacagtggcaggctgatagtagatgcgggaggcatcgaacccaaatagttcgctcagcttttgaagacacatgtcacgattctttccgatactatctggtgccatggaaagcattgccgaaggattagcgcctagggtgtcgataaaaaccatggctgcaccgtgtatgagtgcaaactcgacgtcagggattgagcatttgttgacgaagtccacccatgcaagaagatcacgaattgagacagaggtagctgaggaactttgaaacgttttcttgaaccatttcgcgaattccagcatcgccttcgcgcaacccgtggcccgtgaggtcaatttcgccgtcaggattggtaagatgtcctcgtcttctgacagctgtggaacccatatctccgtaagtcgattccttagagccgctgacaattctctctttccgtaatcaccaccagggttcattgttgcgagaaattggaatccctctctggccaccaccaaggaatcaatgggacctttctcagcaaggaggagtgatcgatgaggttcaaggacgctattaagcctctcaagaacagagtcatcagcgagagaaatctcgtccagaagaaaatattggccagctttcatagcagtcacgagactcccatcagaccactcgaacagggcatgagaccgtgccatattcgtgttaatccgtctcaatagttctggatcgctggatttcacttgttccggactcaattgagaaaacatctctttcagcaaatccagacttttggcctcgacatcctcgccgagtcctggtaggtcccgcatgagagctcgcaaatcgtccagcagctgtttttcgattgcagatcgattcctcagtggtctttgggcacctatcagatcacccgtctctagattgacatgggcgttaactgtgaagagctccttgccatgggtatctgccactgcctggcaaagctgggtcttcccacagccagtttcacccactagaagcacaggttcgttgttctcaagtgcctgtgaaactaggatgaagagacgcctcattgcctttgtccaaacgatcccgtctggaagagtccgattaagcgtgcgcttctccagctcagaagagctgtaaatggcatcttcatcgatgtgaacccgcatcacctcttctatcaccttctttacagcttccctttcctgcggattgcgaactctttctgcaagtagcatgaacccattaatggccaattgctcgcgatcatcagcccgacgaagggcccatcgaaagagatcacgcagggtagcgaagctattcttttgctcaaagagtctgctagactgtcttaacatagaaagcttcttgtaaacagaaacaattctggtacagaaagaaggtgcgatctggcttctttctttaaggataaactccaactcgtcctcggggatgtcgtcaaagtgcaattcaaggaaccgatttcgaaaggcgcgtgacaagaccttccgtccgccatacagaccagcaggattttgcgtggcaaagagcataaagtttgggtgcgggtgaatgacttcctgcgtttccggcagaaacagttctctgttgtcgtctagaaggcgattcagcgcctctaacacgtccgaaggtgccaagttgagttcgtcgaggacaatccaatatccattcctcagtgcttccacgagtataccttcctggtaacgtaatgtcccgtcgtcaccagacacgtaagaacccaggtattcttgcaaatccgtgtggtcgtgattgttgatgcggacgaatttatttccagagatctttgccagatattcgaccatgcttgtctttcctgaagaggtcggcccttgtagcagaatcgggaaccgccgggtcgagctggctcttagcagattcttcaggtttttctcaatgaatggagtgatgatataatgaggctgtttttctggggtgaagggacccttcctcatccagtagtgcttgaactgcacatactcatgaccatcattaggcggtctaggtgtctggctgagaagtgacctcgcattcttggcggtatcgaatatatacttttcaatgagcggtgcgactagcttctctgactcttgactcaaaagtgtcaagaagctcatgcaaaagccctcatatgcagcccgtcgaattccgtaaatatgcacatgatcgacgacgtagatgagggttcgcactagcgtacgaatactgaagtgcggtcgctgtccagctccatccgtaagtctattctccactgccaactgcttcgttttcaggtacaaatgagcaaggtctgatggcaagcgaaggtcgccgatcgtcagatctcctagataagtctgaatcagaccaagcagatcatcgaagtcgctatctggggaatgaacgtaaatttccgtaaaccgagaacgtagcccaggagccaagtccctctttcctgcatcggtagcggggttcatagctccaaatatgcggaagtctggatgcccataaaccctttcaacatctccggcttccgagagcagtacagacggccggccctcatcaccatgatggagcagactcgcgatactctccagtatatcgggagtagctaaattgatctcgtctaacaggacccattcgccgtttctcagagcccgaacgatctttccctggacaaaggcaaagacaaatttcgaatcccctctggttgcgtgggcctcgaattccttcaattgagcggcaaacgcctcccacttttcccgcagagctacgtacttcggcgagtctagctttctcttctttgacggctgttcctcgttgcccgtctgcggttgactggcatcttgggacacacgaaaaacgccttgggccatgcgaacggcctcatgccaaagattgaccaaccggggccagttgcctgcagtaacactctttgccacagatgaaagaaacttttggttctttttcgccgaaaacgtgagctcgaatagctggttaaattcatccagcagaggaacggccatcgagcgaagattgacaggtctaaagcccccaagaaggtctgtgctttcactctgctgtgaaaggttcacgacagtgagtttttggcgcatcagactcgccagttgttgaataacagccgttttaccaatgccggtttctccgacaagcaagacaggctccgcaacttgcacggctgccgcaatctgctccatagttttcagagcagctcttgtgggagcaaaccgagaggagctttccgaaaatttctgtttagccatcttggaaaccttcattttcgtgaaagactctcttccaaggacaaggttgctgtcacgatctgcgtatggaggagtgcgctcgtggaggcagaactctgctctctgaggagatagttgaagcacttctgccacaacagacgatagcttgtttccgagagctctgtcagggagataacgaaggaagacgtccacagcatccagaaatatctcatcctgaacactttcaggagtcgcttcgttaccggtctttgcacccaaacgctgaagtctccgatttaatctgttgcatagcttaatgaggtcacggaagccgggtgtccttccctgggagcttctcaccgcgagactgctgtgaaaagcggagcagagtcgatcatacacatccattaatgttggcactcgcgatgacagcaaaggatacttttgactgattacgtcacggatctcatccaaaggtaacgaattgatctggattttttcccaatgcctaatgcccagtaaaccatgaccgggagcaatttcctctcccttattgttgagtgaggacttcatcgttgcaacgattctaaatccatccgcgcatttgatccgttcttttctgcttgggataatcagttctcccttctcaataataggaagcatgagtccaatgacttctgaaggagcccgatcgaggtcttcgatcaacacccagcggccctctcttgcggcttttgtcaacactccaggctgccacgcaaaagccccagtcatggaagacgtcgcatacatcccaagcagactctttgcatcagtctgctcgttcaaatgaagtgtgaccatagatgatccttggcccatcgtttttgcaatatcattgaccagggaagttttcccagaatttggcaatccaaccaggagaagtggcttgggccgaagcagtgctttggcaatcttctggagattttgcacgactgtgggtgtcttcacaagaacagattcagcagcaggcgcgtcccatcgcactttcggaacaagaactccaccgatatcagcagtacgagctgtcaggtgggctctgaatttctctacttgagtcagcgcatcctctgctgatagtaaactgcgtctctgctgaagattcttgtcaagagtctgccaccgtcgttcttcccacagcccgacaagcctgtagtcaatggtgatgccctcccattctccctcaatgggcccatcgccgatatgagcttgtagcatcttctctgtagatgcgtccgcggcatgcatatataaacagaaacagcggatagccaagtagcgcacgcatctatcagagtgctggaacaatgactggagttgaagcggcgacacggcgctcgagaacgactccaggtcgaaagacaataggcgaaacaccgccagaagcagtgtgcggatcgtaacatcgtccagttcgagaagcttcaactccctagaagtggccaatgcagtcaagggtccatcttgcgctgcgacgcagcggctagcgaaagatcggaggaatggcgcaaagggcagaattcgagagaatgccgagatgactcgaaattgatggacctgaggatccaacgacagccacctggctgccaaatccacgaaaagaggctcgtgggatgaaaatacccattccgtacagttgggttccagcgccgcaagcgcgagcgcgtctaaatactgagacccagaagcgctgcgtaagagctccgcaaggtgctctggaagcaggcgcaacatctgggactccgaaagagtcccctcataggcaggtctaccatccatactgggcgccctaccgctggggggaagctcttgattgacttcgagcgaaagtcgatggattatcaagtccagcggaaacttttttgatagttttattttctgccgctgtactgtggcgtcgggagctcaccgccttcgatctgatcggcggaaccggactagcagacttatcggttatcgggccgggtcaactacctagctccctgtcagcctgcggaaccttggaagccgatcaaggccatccatcgagtatggcagccaggtcctgcaggctctgtgtcctcgatgtgctcggatgacaagccatgtcggtgacaacgcctggctcaagcggtcacggtcaacagacctttccgcaggatgtgtacgggaacgagggacgagacattgacggacacgatgattccgacagcgacgatcccgtgttgaggcatcaacgcgacgaggcactgttcgctgacgatccgcttgcacagagccctgaggacccgtgagtcaagattattatgcatctggctatggctgcttctaatcatgtctctagcatttcttttaagcgcaaacagaaacggcccgctcgtttccgcctagggaatctcttctccaacagcgccggcggctcacccccaagacctaatcaatcgacgtcccaagtcgcaagagaggattctttacaagggttgtccagttcctccgggtttcatgggcagtccactactcacggaggcatcgacggtttcaaagaaggaggaccgctagattggtatgtggaagggccaggtcgaagggtgggatatgacgatctcacggccattgattggattttcgagtatacaaaagaacgacaaaggaagaggctactttattccagcggtcaggggctcctaggccatttccgccaattgctcgacgcgagccatgtctgggtggtgcttgtcgcgacgggtgtggcagtcggaatcatcgcagcatgcattgatatcgcaagcgattggttaggtgatctaaaggccggatactgcagaagtgacagaggaggcggcaagttttatctcaataagaatttttgctgttggggccatgaaggtgacacacgcctatgcgactaatattttctctccagcgctaatgtctgcccaaaatccagaattttcgcagtgtattggctggacgtcgtggagtagagctttgggaataaattccgctggcggagcatatgtggtcgaatatatttttttcgttgtattctccgtatgtgctctctccgcacttgcttgctcctgatgatttctaacattttgagtggaaaaggtgctttttgcttcttgtgcgagcatcctcgtccgcaattatgcaccatatgcaaaacatagcggaattccggagatcaaaacggtgctcgggggctttgttatgcggcggttcatgggagcatggaccttggtaattaaatcgttgggtctggtatgatctcttctatgcctttaaagtcccgttcactacttacgctcaaatagtgtcttgctgtcgcctctggcatgtggttggggaaagaaggtccactggtacacgttgcttgttgctgtgcaaatctgatgatgaagccatttgacgttttaaatagcaatgaaggtacgggtagtgcatatgatcattcataattactcatgctgaaaaattttacagcaaggaaacgggaagttttgtctgcggcggcagcagcaggcatttccgttgccttcggagctcccatcggcggcgttctatttagcttagaggtatgcctgttcaagataacgtccttttcacagtttactctaactgtcattagcaattgtcgtattattttcctgataagaccatgtggcagagtttcgtatgtgctacggtcgccgcagtcactctgcaagccttgaatcctttccgcactggcaagatcgtgctctaccaggtcacctatacccggggatggcatcggttcgagatcctcccgtttgtgctcctcggcattgtgggtggtctctatggaggcctattcatcaaactgaacatgaaggtggcaagatggcgcaaatcgcgaggttactctagtccggtcctcgaagtagcactagtcgccttcatttcagcaatgattgactttccaaacaaatttatgagggctcaggcgtctgaactcgtctactcgttatttgccgaatgttcgacttctacagacgatcaactggacctttgcaagacaggtgctgcatctgctggtgtaattgctctcctcctccttgccgctgtcttgggcttcttcctggcatccgtaactttcggcctggagatccctgctggcatcatcctcccttccgttgctattggtgccctttacggccgcgctctcggcatcgcgttcgagatgtggcagactgcctacccggacttctttctctttcgcaactgtgagcctgacgtcccgtgcatcactccgggaacatatgcaatcattggcgctgcttcagccctaggcggtgctaccagaatgacggtctcaatagtggtcatcatgtttgagctgaccggcgccttgacctatgtgatccccatcatgattgcagttatgctttctaagtggtgtggtgatacatttggcaaacgaggcatctacgagtcgtggatccatctcaaggagtatccgtttctggatcacagggacgacaaaccgccgccagacgtcccggttcacaaagtcatgacgaatattgatgatctcactgtgattcctgcagttggtcatactatcgaatctcttagaaatcttctggcgaaaacatcttaccgcggattccctgtggtgcttgacacgtctaatccaattttgctcggttatatatccaggacggaattatcctatgccctaaaatcctccacgtcacccactaacctacctccggagactcagactcttttcgttcatcaaccgtttgccgacccgctggagacgctcgaccttcgaccctggatggaccagactcctattactcttaacagccacatcagcttttcgattgtgctgagcatgttccagagacttggcttacgctatgtgttatttgtcaacaaaggcattcttcagggcctgctcaccaagaaagatgtttggctcatactcaacggagctgagactcgtagagagaagggcttaggagatggagttttaagggaaggcaatgccgcagaagagatgggtttgctagccagtgacgacggcaatagtgtgattagccccttggagagccgtcaatcactctgaaggcttattgggtttgcttttgtgttgtatagatctctgtttgaaaagatatccaccatatgactgcttaatgtcatgatcttcacttatttacacgtactccactgtagaacaatgttctggtcgacccggtcttcggaaattggaaaatggcccgaaacgcaatcatcaaggctacagcatgtttgtgtcgtggagaggacaagaaacttaatggctttctttctttctttcttttttcttttcgggaaaaatcaagatacagggagaaaacaaggatttcccaacgtcctaagaaatacaccagttttcaacatcgagtctaccaccgggtaccattaacaccctggacgcctttcccgagctggctcgcaacaacagttgcttctctaacagaacgcgccaggctccctctgactgcagcctcctcgaggacgagcagtccaccgatggtacacccaccaggggaggaaaccttctctttaacaatggcgggatgttcgccattctgaatcatactaacagtgccctgcataacttgacaggccatgagctgtgccgtggcgcgcggcaggcccattgccacagccccatccgtgagtccttcgaggaccaacgatacgaaggcagggccagagccagctagtgcggtacaaacatccatctgggacggcgggagatggaccaccttgccaatgcgtgtgaagatccaggaaaccaactcattccactcagaaggcaagggaacctctggggtgccaataacagtcatcgactctcgaaccatggctgcggtgttgggcatagcgcgtacgaccgtgcatctctccgacacaggaaccaacccgtccggatacaaagtatcttccacttgcttgacagagactccggccaaaacactgatcagcaacttgcccttcagagcctcccggataccaggggcggtcaacacatccttaagcatatagggtttgcaacccagaagaacgacatcggcttcctggacgcctttgaggttttctttctggaggactgttacgggaaatttggggtaaacgctgacggcatcttgaatgcgcttcgctgattcaggccgctgtacgcatgctataaatctcgtcggaggctgaaaagaaggattctgtatttggttctctgtttccgagagagaagaaaggattcccgtgaggatagcaagacccaaactccctgcaccctcttgtgattagtgacatctgtgtttctgcattctgaccactgcgctgtcataccgcatcctaggaaagtgagagtcttctctgatccatcacggccattggtggggccctgggcagacattttctttagcagtgccagtaaagcaaacgccacaacaaatggtaataagtggcccctgaaatattgtggttgcagaaaacaatgtcttatcgatcgcttctgtcttcactttttgtcactctgacagtccaatccacaatgctccccagattcgggcggcgttccgatggcggactggaatccccacttattctgcccgccaatgcactcaccgccttacaggaagaccaatagccgcagcgtaccccgttcgccgcatcggagcatcaggtagcttttccccctcagcttcagttgtgcaagcaactcaccacctttgcttttgttgttgtgtcaaacaatttccatcatgacagatccgtttgaagtgcgcatgcgcttcacagcgcagctccaacatctaagtgcgtctgtcacatcatcccagaaagccgcccactatgctctcaagtaccgcgacatggacgaggatcttcactcgtgtattctagaacagctcgaaagggttcgttccactgtactctacaagatggaagactaagcgtctctaacggtttccccagaataacatgaacaacagagcgaacatcatgtatttcatcgagcatttctgcgaaatggccacgaaggaaaaccaccttaactacgtccggatgattcagagggatattctgcgcgtggtcgatgctgttgcgccagcagacgggtccggtgctgccaacgtcaaacacgtccgtcgggtcctccagggtctacagaacaagtcgattctctctgccgaaaccgtggcggagattgacgccgctctcaaagagcgtgaaacgcaccccttacacctgcttgaccttgaacctgcggagggacaggatgcctcggggaaatcgaagtcggggaccccgcgagggtcgaaagccaacggtatcatgcgtgtcgataaaaggcagatcgagcagcggattgaagaggatcgagagcgcaacaaacgtctacgagaaagcatgtgggcggtgagcggtgacgaccgaggcgagtttcggaagttctgggacgagggtagtgatacgggggaagatgattatctcggagccgaggaagaagtcatggaaaggaaccaaatggtggctgtgtgagccattggcttttctgtatttttcttgttcctcttttttctctctctccaggtctttttttgcaagtcctgtctggctacagggtatttcggagttatgggtcatgagaacggctgctatgggaactggcgtgcattatttacatacattacggaatacatgtatttttctggccttttactagagtgtcaaggtgtttggtgttaccagggataatcctcacagataccaagacttcaaggcatttggtcaatatgtgtacggacgctgcaaacaaataatgctgagcgtcaatgccacttttgtcaattaatgtctgtattcgtatctgcaattaccgtagtttttatacagacggagtagggttacccttcggtgaaacgtaaacccgggtagtcgcgagtggatccacgaagcggtgggttttttgatctccgctccggaaaataaaaaatacagcagcaagtttgcagcggcataccgccctttctttttgcagtactgggcttaattagggctgtttgcaattgactttcgtttttttggtcgccctatgttctcgcaatttttcactgcggcaaagggtctattcgcaacgcaggactccgccccagacgtctcatccgccgactctcttgcggcctccacgaacggaccccaaaatcaatcgcctcaaacttctaacatggtgactgttacaagacaagggcagatttcgtccccggagtctggggattctccaaagttgaatgactctggcatcgcgaacggaaagaggaagggtcgcccggttggctcaggcaatacggacggtcaatccaacaagcggaggaagagagagtccttggaggtctccgagcaacacgattctcctgacataccagaaacacaagatgtgaatggtggggtgcagaccggcgctgtcgatggagtggaatcccccagtgaggaaaaattacaagcctcacaaaacaaagatcaaattgcagaggagtccgcatcagctccgaaaaagtcaaatcacattcgatttggaagcgaggaacccgacgaaccagtgaacatggtggaagaggaagttgcagagactcaacaagaagaggaggaggaggaaagcgatgacgatgaggcacctgaagccatcgataattctgcccagttgaaggcactaaaggctcaaacacagaagcaggaagaggctaaaaggaggtttgtgctggtctaagactacacgaattgacccatcaggctgactgctttcagggccgaacttctgaagaaagagaaaagaagacagttggatgaacagctcaagttacaggccaaagcgtcgggcaagaaaaagaaggagtcatcagtgggatcgcgaacgtccgagcataaatcagctccagatgactcggtttccgaaagcaccgcaacccttcaagggtcagtcgcgaaggagtcgggccgccttaccctccctgcacttctccctgacgagatcttgaacgcggaacctgttgctaggcctccaacgcctccaccagagtcaggcgaccttcagcggaaaaagccccaaaaactcaagtttcttgagaaggcggagaagccacccaaagatatccatcgtggtggtgtgaccattcgggttctagaggaccattcgtccagcaagaaagcgacgcccactctaccgccgaagatgtccaaagcaggacgcaatatacgagaggcctggatagctggccaacgcaacaagaataatctcaacggtctcagacgggtccctgggggcccttcgagctttgttcgcagccgatgagacgatgccaaaaagtaatcgacgcacaattcttttttcgacctgttccagttcaaacgtcgtctagactcagtcgatctgtcatgtgacagccgctacgacaccggttcctgcctttaatactctcggtgacagagaacagcaggagctcaggaagccgtgctatgacgagcacttgatcaggcgacgcagaatgaaatagtcgccaggatactctatcggatcatccagaggaagcgagccttcttctaacttgtgtctcttaggcattctggtgtagagctacatgtactgggtactggtagttgtgcgacaaaatgagatacccggtccttcagccaagcctggtctgtgcagttttgaataattccatagataatgaaagtacatagttgcaatgtgctgtctttaacgaccacataatgtagcgattccgtgagcttgcttgtagttcctaatgcgggccgccgggccagtgcacgtgcggagagcagcagttcgcaggcggcagcaccgtctgggcgggtccgagctccgtcaagccccaagcaagatacgctgggctgttcttctggatctgcagcgcttaacaggcaggttcggtcccttcgtgctgtcaatggaactgtccttgagccggcctctctctccatcgccttcatctcccccaatgccacagcgaccatggcgacaacagaaacctctccgctcttaccccaataccagcgctctggctcctcgactacgtcaccgcgggcagaccgtccgactcgaacggtgacattcaatcctctcaccaccatcagcacctacaatgggacatcaacttcagattccaccgtccggcccttgcagacgggctcgcctcccgtatcgtccagtggacagcccatgctgtctgccttgaacagcaagctccgcaggcggaatagctatggcgcgccctacaatactccgagtactgccccagccgcccctaagatcggaccgcagaggacgacgaagaacgcacagaaattgaagcttctacctgatcctgtgaccggcgaggaggacgagttcgtcgacgacacattcccgcgtgatgtctactcgcagctcacccgcatcaaagaacccacagcaagaagagacgcggcaaggttaggtaaagcggatcgcgatcgcttaccaagggtgacggcgtattgtactgcgaattcataccggctggacggcgtcattcgattcctcaagtccagagcaaagactcgcggggcaaatccaaagctctacgatgagtgcgtctactcgccatacaattacgactacgaggcaagacaggcagaaacatcatcgcagggaaagaatgggcggaatgcagatgccatcccgccatcgaaaccgcagggcgagcgcagatattctgacagcgctgtggaggttgaagacaacacgaaaaatagacgggaagacttgatcgatcttagtgatgaacgtgccgaacgttcaagaagtgcagaatcggtgccgtcttcctcggaagtagatgagcgactggatcttgacaccactgttcacacccccgagattttcctcttcgactacggcacggtcgtgatttggggcatgactccggcgcaagaatcgcgcttcctggcggatgtgtccaaatttgcgacatcgatcctgagccctgaggatacccaagtcgagaactttaatttctactatgcgcgtgattatcaagcgcgcatatacaacgatttcatctctctccgcgagccccgaaaccacatgatcaagctcgccatctctcatgcattgtcacagtcagtgaaaacgtcgcttttcgaggatctcgtctccgaaaccatctccaaaacggcgccgcttcccgctcagattgcgaagacagggagcgtcaacatgacccggcgacaaatcaacatgcagatcggggaactttttatcctacgcatcaacatccacttgcaaggatccgtgctcgacagtccggaactcttttgggcggaaccacaattggaaccagtctatcaggccgtacggagttatctggagatggaccagcgggtcggcctgttgacggaacggctagacgtgattgcggatctcctggcagtgttgaaagaccagctgacccaccgccatggggaatatctagaatggattggtaagcgatttccatcctttcgactttccagctaacatttcctgcaaagtaattgtcctaattgccgcggaaatcctcgtcgctgcgatcaacattgttgtcgatttgtatgccggagttgagtagacagagtctgcttttatttgttcgaccttttcatttcggtactcatatctccttgtctttctcatggatacattgggtatatctcgggtcaggacaggttatattcatccgcccagttataccacgtccgaaatacacatccatacatcatacataccatgatggtcaactcggaatgacgagtttgttttgctcattggtccatcctccgttgagacggacgaattgattgtttcgatcatgggtcaatcaataataatgaactttgggtgttcaatatccaatatcatcatttcaagggccactgcattacactctcgccccgcataatttgtccttgtttttttttccctccttagcattccaggcgtactaatcatcctcatcctccccatcaccacgcatctacttaggtaggcaaggaacaatggacatgtggggctgtattctactgtactgctagatgtagtttttgtgtgtttttgtatgtgtttatacttaaagaagtacaagcaaaagacatacttacttgaacattaatttctgatagttcatctctccttatctgtttctctccctcctctcttttcttcaagcacgaaagaatagaaagggggggaaatggatgcacaaacatacttaactgtcaagcagaatcatcatgaaaaaaataaatagctagatgctagtatacaatcaatacaatatacaaataataaacacatcgtcattatcatcataccttgcctcatccttccatccttccttcccatcccatcctagtttgttagtttgttagtttagttagaagaacgactctcaaatcagacagaataggatactgaaataaacagaacaaagcaaagcaaagcaaagcaaaacataacaaacagaccccatttatgcgtcgaaaatactgggaatcatttcagttcagtgcctaggtaggtatctatccggatattctttctatcctctcctttttttgactctccccgttctagagttctacgccagcagctacctttttttaaggctccctcttgggctccttctcgtcgacttccatggctgatggatgagcagcagcggcggcagacgcttcagcggtattgtgcgtctgatggtctgtcgaaggggctaatgcactaccaccaccaccagcgccggcaccagcaccagcaccaccctggtgggcgccggcggcggtagcggcggcggcagagctgttactgctggtctgcacgcggaacgaagacgacagctgctcctgcgagggagcaggggcgatcggaggaagagaagaggaggccccgccggcgccggctgcattagcggaggcagaggcggaggcggattcggtggtttcgttgttggtggtggtattgacgttgttattgttgttggcggccgtctcctccgcctcgagctcgtctaaattgaggttgggcttgcgcgagcgcttgacgcggagaggacgttcttggggctgtgttgaacggaaagcaagtcagtatcacggtggatcacgtagatacaatgcaatggatatagtgaaagaaagaatgagagggggaaaaaaagacggctccaaggaaacgtaccgtaggaggctgctcctccgagctcccttccgtatcatcatccagataccccgcaccattgttatttccagcaccagcagccgcattgttcagcgcagtggtgctggagatgatcgcggccgcgcgcgcccgcagctccggattcatccccgcctgcgcctcctcgatcatgcccgtgaccttggccaggcgctccagcaggatgcacgactcgagccgcatcttctgcacgtactgcaggctgcgcttgttgcggttgcggatgttgtcgttctcggcctcgatctcgttcaggcgcttcttcagcgcgatgcatttgcgtttgtaggcggcttccacgctgggtgggtttgggggaggaggggccgtgctggtttccatttttctttcttctttccagtattatctcgtaagagaggatatgtattgatctgatagatctgggagtatcgagggaggagatgaaggggaaagtaaagtcgctagttgaggtcgatgtttcggagtgacgttgcttctaggaacttataagaagctgggtacttgggaaattcactcaaagagcaccataaatcgaacagaaaaagagagtcttgacagacgaggtcgaatagcggagacctcctgccaatcaataggtagtcgatcaaccggcgggcgacgctccaacctcctgtgggtaagactattcactttccgaagctttgattagcgactagctcatccagcgacaattagatggataataactcgtaccttcttgagcagtgagatctgccgcccagctctgggatcagtcgtcactaataggaggcaattgaagcttcgcaggcaaatgtcatgataatgaaccgattctgccggcgaccgacataattagatcgcgccgaaggaaggcggtgaaagggtagcactactccgtaaaccgtcaacaccaatactgcctttgctttacttctcgtccgttgtctttacatgcgcaattaattaattaattaattcattgattggttatatgtctgtgagatgctatgtattttatctgagcagactgaatcgaaactaggcatactgactggtctacctaaacccccgagatcgaatcgcacgcaacaactgataaagttgctgttcatcgcacaagaaaatccgaaccaaaaaaaaagtttccaaagaagacagattgcgaattcagcgaataatcaagtgaactgagacgtgttcatcgaactttacgattagtgaccgccagtcgtgggaaggccaaggaacaccttgaaagagtcatagctgcgagaagcgatcattatcagccatattcgtatggacgatatcgacgttgcctcacttacatcaaccattggaagcccgtcaaagttcctagcatgactattctgacggcgagaccgttccacagccccgtgaaaccaatgttaccgtagatccttgacacggccgtcatggcggattccccagctgaaagaaacgtcagtatgctcgttgagaaaaaggctctagaaaggacacgctcaccctttcggtcggcatttagcttgctgaccatgacatctgcaggatggctgacgatggcacagagaataccagcgagataaccacccaggaaactgattccagtctgcacggccccgctgtagctctccttgggcttgcccagggtcttatagatcaggtttaccgtctcctcaaaggtagcgaacttggtcatcgtgtacgggatctgccgggcccagagcgggtagagacccttgtacagcccgctgatgccctcctgagccacgaccttgcgccatccatcgcagagggtatgcgcgtagggagggagcgtcgtctgcatgcggaccttgaccgcttcgtacgggcagagcgcgacatccgcaaggaactcggccgatgcgctagcaccgaggaagaccaaggtgcggttgcagttggggaacagcctctcaccatagaggtacttgaacacctcataaaagccgtattttcctgctccctggaacgagtaacccacgaaggtcggggaccaaccgaagaagacgccacgcaggccttctttggcgtagatctggcgccatgcggagacgttggaggtgtagatgttgggatcaacctgacgacgacattttaccaagtcaaggggagtgatggccgtatgcgttggtcctgtgtcaatcatcaggcccgaaatatcacctatgattccagcaacacttaccgcaggctataataatgtatccacagaagagtcaacaattagcctctttgttttcgcaacattctgggacagtttccaggatatgatataaaaatctcctactcaccaataacccctcccagagcacagctccagaaatatttcgcggaatacggctcgatcttgccaaaggggagcttcctcttctcctgcaccgcaggcatggtgttggcgttgatatcgctcgcctgcccagtcttcgattctcagtgagactgctgacacgtgcttattgtgttccagtcaatgggttataataagtaagtactgttgtcgcagaaagaggaatcaaaaaacaagtactcccttctttctttatcagtgaaacaatcaaccaaagaaacaaaagacgagactagccttgttatatatatgctcgcgataagaacagcagtaagcagtaactacgtcagacagcaaggttccaagaaaatatatataaattacagatcatgtactgtaactatggcccgtacgacacaacagacagggttgcatctattatcgcaggagacggactgaaagagattattttttttttgaaaaaaaaataccctaacctatctcatacctattaccacttaccaggtccattgtctttctcgtcaagacattcaataatggctattatggctattgttttctgtatttagctgccgaaggcttccgggaacggcaatgcacggtcgatgacattattgaaggcttatcgatcgatcgtggccgtcccgttcgcggggaatacggactaagacccgcaaggtaacgttaactatgcaatcttattaagcgtgactaagaacataggtatgttgaatacctaactctcgttcgttaattatagctactactgtgctattccaatgagaatcctaggaaataatcgatacaagctacacaataacaatactgcttactactgcttattatcagcaatctatcaattaattatataaattgatgcatgcgggatcagcccaaccaatgcattttcatttatatacatacaaattttgagatccactctacttccaacaaacaggacgaaccccattttgaggacgatattttaaagaaaaactataaaaaaaaagaataaaaagaatcaacgatcgaaaggcagctggactcgcgaggaaccccggacaaccccgggcgtaagactgcaaataccgatttctcttgttccagaaagagatcccacatttatttttaaaccacaagctcgctaattctggtgagtcgtaatgtcgcacagataaaattctgaatgccgtgtctttcgtatgagtgcagttgaaatcccaggaaatgtaccgacacccagacaagaaagatcaaggttcaattgcatcagccagccgagatgccaacttgattccaagaatcgacccaagccgctgcaatgcattcctagcttgacgcttttgcctcggggtagagtgattgttggtacagatgccccataatggccatattaactcgtacccctctatcgctcggagccgtgagttgttgcgacgctctcccagtcctgacgaattgctggctggctgggctggattccccatcatatcaacatctcccaatgtaaatgggatgctcttgcatatatcagagatcaggtcgcggatcatatcagatggtgtcacatcggcagagacatcgttgacttcatcttctgggtattcgccaggcagcgactcgaccatttcatacatattctggatcatactctgcaggatgatccgtgcagaccgatagaagttccagagagagccagttgggacatcaaggtatgtcagcaaagattccccgggcatcgagtacacaaccctggggagccactcatgaggaagatttcgacaccagcgtcccaattccgaatccaatgtctttgcgtgcatgatacggaaatgaaagtgtgctctggtcacggcgctgtcgacattctttgcggagagcggacactgagcatccagcaccaaacgacttattttcgtcacagtggacattaactgctgtaatggatccgaagggtcaaagagttcaactagggaccctaagtctattctcgggcgattgcccaagcccagaatctggatttgctgtatgtcttgtgagcatagcgatgtcaccaatgaccatgtatacggatacacctaccaattgtgcatatgcaaaattgaagagacatcggctatacttcccatcaagtcttctttggctgtggagtctcgcaaaaagctcaaagcctgccgtatgggaactgtgaagccctcttcgctcaccattgatgtcctcgaaaatggcgagcaggaggatcgcagcgagcgtttcatcctttgctgattccgtgggggacgcaagcgcctcacgaaggccacgcagcgccatcccatacctcttcctcgcctggtagtctagatgagaggcattggcttcatgggcgaaggcgctgagagctaccgcatccacggcccatcgcaaacataaggaagaactccctgccacctcattctcccggcagagtatgtatagagctggaatagactctaaaatgccgagagcaccatcagacttctttgggatcgtatattggtcaaagaaatagcagagtgcccggtcttcccatgtcgcatcagcaaggtatcttaaacgagacaccagtgaggtattctcggaaagagtcgaatcggcgaaactcgaactgccttttctgaccggactcctccatcttctgaaatgggcagttgcaggctcattctggaagacgattgcaggccgatatccaggacactctttcccatacacgaaacaattccggcagccaggcctagcctcatcgcactgcaaattgaaattaatttcaatctaccatgtgaatatcaactacgacgtagataatgcagacatctaatgtgatggacgtcatgtagcacgagaagaccgctttacccaccttgatcttccgccggcgacacagataacatccagtgcttggcttaccgttgtaaaccattgtctcgagcaattcctatcagtgcaaaggtttgtatgccttcattttcgtctccaacatatgagcaggatctgttgtgttgggggtctggggggctttgacgccaaatctgttgaggcgctgtgctggcttcctgatgggaaacaacgatatccagagctgcatattagcagtcctgctctcttgaatttttcttgcagtttatatgatgcatgctaagtccacagttgtggagtgaatcttgaggtgctgaaaggaacagaacatggttccctctgtatcgtccactagtaacaagcctcttgactcttgaatccgaaacaaggagttcttgcagggattagtcatcccctcagcagccgtaattagcagtagaaactgtagtaactgcattacttacattcgacacttaaacgaccttaaacgactcatctcgcgcgttaaataatacctggtcgtttgggaccaagaagaaatctaacgtttcagatccaatgcattcctgaaacacataaggacaagccccatgtctctactctcaaatgctatctgatgctaagtcgggcatacaataagctattgcactgtctgccatgctagacgttcagatagccgtcatagaaagaactccgcgccggactggacattatatattccgtcgtggcgagagaacacacatattatccaacccgttccaagcagggtatcataatcctgcaacatgcagagatcgaagcatggagggtagtgctaacataaccaaaaaaaaaagaaaaaaaaagggacagcagtattgttcagaaaacaaacattatgcataaatgctccagacataagtagggacagattttcaaaagaaagctcagataaggccgcttggaaacaccagatcccttcataaatgctgcaatagacgcaaacgacacaagatgacaggaatattagacaagctacgccgccgactccgtgagctatgcatcaaccaatgggagcatccgacatgggctgatcgccatcctctgccagcgatatcgtcggcggcggatccgacattagcgctctttgcctgctgcttttatcgccagatttaccatccctagtcggacgcaaccccggcgtgctagaagcgctttcgatcaccacgttatcgtcaaagagttcttcagcaggtggagagaaagaccagacctaataggccagttagcaacaggataactctcaaaacaaatacaaggctggggtacagggaagggaataagaaaagttgtcagaatggagatacccaacttacctccatgacagtgcgacctgaccggctcgccatgatcacggctttctcttcctcaaatgccactctccaaactgcgtctgcaggcgtcgacaactccctcagcagctggcctgttttgagactccagaccttcacacggccatcgctaccaccgctgacgatgcgggtgctgtcgaattgaagactagtcacgctattatcatgggcagccagccggtggatcggagccatccgggtcaacgaccagacacgaacggaaccatctgatcccccggtgactaatgtatcacctcgcatctgtagctgcccgaccagagaagtatgaccctgcaaaatcgcctggcagtgaccggtgtgtggatcccatatccgaacgctggtgtcaagactacccgtcgcgattcgcttgccgtcaaaggcgattgcatagatctggctgaaatgaccagagagcgtccgcaagcaacgcccttcggaaatactccatatccgggcggtcgtgtcatagcttcccgaaactaccaggtccccgtggattccaaggcacctgacactagcctggtgaccgaccaggacgcttctgcacattccggtggaaagatcccagattctcaacgtggtatctcttgagcccgagatggcggtatttcggtcggccatcttcaagcatctcaccgtagatgtatggcctcgcaacagatggagacaagcactagacaatgctgtcagtcttcatacactggttcaggtccgaaggcaacctacccagtcgccatgttccaaacccgcacttcccggtcacaaccaccgctgaccaggatgtcatcccacggaaccatagcccacacgcccatcacatgcccctgaagggtcttctggtttgctccattggtgtcgtaaacatggatctttgcgttgtctaaagcgacgacaatgtacttgggagtcaggtgcaagcttgtcaccacaccttggtccggggtaacatgtctttgtgtgcaccgtccacccttcctccatgcagactcgaccatgtacttttgcttgaaatgcgttcggtacgaggacggctgaacccgtcgcttccgcgttggcgtactcggccaagaagactccatggacaattcgctggacgtaccagccatactatctgtagcggatgacgtcgactttctccggaagctatgaagagaggtctccgaactcctcgcggaagagttcccatggaaagggtcgacaaaatcgcgttcgtcgtccgacagtcttctgcatgcatacgaatgtttttcacacagattcttccatgttatgtcatcattgagaagctcgtgccaccgcttggacacctgggaagctctcgcaagcgtcttgggatcgtcgatgaaggagaggaccttatccagatgatttgtaattagcacatatactatagcttccacggagggaggacctccagagaaatcatcgccttactctcaaacacagttcatttggaaagacctggaaaggatctttcctcagacgagggctcacaaagctggaaacaaagctgagttgctggttgtcgcacagattcaagatgtcgaccaggaatttttgcttctgagcactgctcagagagctaaaacgtatccgggcgttcaggagcaatgtatcgtcgtcatcttcagaagactgccagctggaagtcctctgatgcggtgtcggacttggcgcgggagtcggaggggaagccggcgtagaggagagcagactggtgtgcagaggagagctggatttgttgggagtcggcaacggctttgggtgagagctcgaatgatgcgagtgtaggcttctgctccctgatatccgggacggaacactcgtgagcggctcagggacactgcgaggagtggtgtcgccatctgcagtctctctcaacgaggctcgccgctggctcagggagcgcggcggcgtataccgcgcagccatggcttggtcgactggtgtacgcagcagaagaggttttcttcagtcttcggtcttcaatgcaagctcacagccctttgtatgcccacagcagccctgtctgagaccggctgggggcatcaatatcgaggtcgggacgagatagagaggagttccgagttggggaaggtgggcggctcgccgaacggggtaggttacagcagagagtcaggggaacggaggcggaatcttcaatcgaggcagtgcgcgagaggccatccgacaggaagcacggggtatttctgagctctgatccggacggccagagcattcgagctgcacgctggggagatcgccgatggtcggggcaggccacagaccagactctgcgaagggcgctcggcatccagctgggatggggtcggtcaagccgtcttggggaggccgcctgaccgcgccaagcacgacaccagcctgctcgctttcgaagacggccgctcccacgcccgtctgcagtcaagctcgcgcctctacagcacgcctgcaggggcccatgaggcccaggtctgcatctgaccgactctcattgtctcctgcttgcctgcgcctttttatatcgagatgcagatccaccggggtcgcaggtgggaacccggcagcatctccgcatcgtgcgacaccgctgcacacagggccgtggcaactagctctgcctgcacctcctttcagcaagatcagcactagttgagcgagaaccagacctgtgcattgttccgtctaacagaagagaagcgctgcaaactgcaaaatgcccaccagagtaatgtggctgcggacatcgcctggccagaatcgtgcttgctgctcacggttgtcaaaattagattaggcaaacgcgcatcactcggtgtctatcaggaccttgcctgcggccggaactctggactgttgttccaggtccttggatgagtgcctttggtagaagccatcgaaccgtggaacagattgcagttgaacaaacggttgcatcacagcaggctccgatatcttcaaacagtctctagattctacaaagtgaaaaagccatctcattattgattcaacaagcactatacataaaagctaggtcggcccaatcagagactgcatctgcagctatggaccccacgaagacacgttggctcgaagaaaaacaataaagctcggataaaatctctctataaaaacaatgatttgggggagctcgatatcttgccccgcaaggaatcctcccacaaaagaacctattctagtcgggtacagagcgtattcgcacactggtaacgatgaagccaccttaatgagcatgaccgatttgcaagaataacggcaagagcatgccaataatggaggcgatcaggtctctcatggatcccttgggccgttgtgtatctctagactctgcatagccgttgctatacgaatcgtatgaggaaggacggggtgcgttttcctgcatagtgtgcatggccacataccttgagacctgttagtttacggggccttgacgttcaggcgtaaaagcaaaataggaggaactcacaaaaatgtcccggcggagaacaacagtagcatgccagtccgccatcgggttgctacctcatccccggccaagcctgatccaacagtttgcacaaagacgaatgtcaacaaagctcccaccggtgctgctaagctaaagaccaacaggtgagctcgagcacttcgactagagaggccttgcttcagcaacaccgacgtcagcccgaatgaggcgggcgccttgtgaactagaagagcaaggaagatgataaaactcaagttcgtattggacccggacgccccgagtgcgatgccatcggcagccgcatgaatcacaagtccagtggtagtcgcaaagctgtggctgcgtgatgaggggctatccggctccagtagtcctccatcccgggagggtgaagcgctgcgtcgcaatccggatcctaagttgtccagcgagatatgatatggtggccgtttctgcttcgagggggatgcgaacccaggaagcttgtcgattaggtacatgagaataaacccgctaatgagggcgacacctatccaggcgtgaagagagcgctcgttatcctcatgctcatgctcatgagtatcgctttcggagtcctcatccctcgctttgtgctcctgtagctctgtatggccgacatcagatcctagaatatgcacctcttctggctgggtcggtgtagatggtgggcttgccggcatcgagggcacttcggggataactggaccaggcatggcattcaaatctgccacacttggaactgtcctcggcagaatagcatgggtatcctgatgctgccatcgtacatccagcgcacgcgcgtgaaggcttttttgaatacgatggatgtcggagctgtatagtgtctcaattccttcgggtatgatgacgattagagcagtcccaaccaggacacccataccaagcgatgaaataaatcgcaactgcgacggagataatgcgaagctaagcggtaatgagccgacaaggaatgacctgttccgaggacgcgaaccgtcagccatatagtcatagaatcgttgcaagcaacaggctcatgtctgtattgctcacgttacagccatcacgatgcccagaatgagcaacgtgaagaggccctccatggttgcttcgtgctccaaatcttcgcgccctttctttgtctaaaatctccagagcatcgtgtcaattccggacaagtatcctccaaacacccaagtaagtttcccccaatgtttggccctcaaaatgtcgcacaattagagaaaggggatagcaagcaatcagtgaagcttgacctgcaacaaaattaataggtgaatgaagaagcatcaaagcctgtcgcggctccagtgttgaggagacatgtggttgtactctgtactgcacaggggtttgcagtatatacctagtgagccagatttggcgcaagcgccaagaaacggtcatatctgggcgctagccaatgatctactttgcaccccaggtatcctgctattgcatattaatatttagatatagagtacaccagaaagcattatattcattctaattctacgaagactatgtcttgcgccaaatgtaattgctcattctccgttgctgtagtagagagaatgccgtatagcagccattctgcacattcatcatccgtcagaaaataatgggtggaagagacatccacagtgaggcaggtatacttagttgcttaacaagatatagcccatcaattaaggcaggaatggcatattatattaaagaaaagatccatttctgtcgatatttttgtatattggggtcgtggtagacatctggttactttgtattcacgtgaccacagggccacgctaaccacaaacagccatagtagtggaactgcatcccgcaacgcggtccacgacgcgcctgcaaagcagctccatccctctcggtcgatggcgcatcccatcgccattgttgctacgatcagatcaataatcgagtcagccgaatctggcccagacgtgtcatcacaatggcgaacgaggattgtaaggaattttcatacgattctgccgcaaccctttcaatcgtttcccgactgacgaggtcacttcctatctagggtcctgcgacgccaatgacgccgtgcagcttaccatagtccagcctggcgaaaagaagcccacgacgatcgctaccttccatccgcaattcacatatcccatctttggtgatgaagagcgcatatttggttacaagggcttgatcatacggctgcggttcgcggcgcatgatttgcgctctcacgtgcatatttcgtatgatgagaagttcaaggccgttggagatacggcagcgacggatcttaacaagacgctgcgcgattggatttcagaatgtgagtcaatgacgatcagttgctctcttgcctcccgttcgatatcttgactaacgtatctgaaatcgtctagctgcatttatatccctgccagaatacgagaaggcggtccagaatgatgagaatgccaaggatttcgtgcctcctggaaagcgagttcatacttatacgacaaacggaagaaattatgagatttgggcgggctcgcttgtggaaccagacgttcgagcccttctcgagcgcgctcaaatattcgtccctctattcatcgaagcgggcacccctctagcgacggatgacccggaatggacacttgagagatggacggtctactttgtgtaagtgaagtcgtaggttcctaaggcgccaattgctcactgtcgtgcagatatgaagttgttaccccgccaacacctactgcttcgaagtattccattgtcgggtatgcgacgacctaccgctggtggttctaccataaccgtgaagggaaaacacaccccacagttggaaacgggccattcccctatccagagcaaatcaagttctccgagctaccgtcccggctccgaatagcgcagttccttatccttccccatcaccatcgctcgggccatggtacccaactctacaccactattcacaaggtctgtgtcgaggatcctactattatagaactgactgtggaggacccgaacgaagcctttgacgagcttcgtgacgcggctgattatcatatcctccgcccggaattcctcaaacgggatttgaatatcaaccccaacccttatcctgcaaatacaggcaagaaacgtccgcgtctgatgccgactgccgcgctcattcccacaaagactttgcatgagatccgttccaagtacaagatcgctcccacgcaatttgctcatatcctggaggcgttcctgctcagtcgaataccactcaaacaccgtgccgccggaaatgcaaacatggcacggcttcttatcaagaagcacaacgccgaggatgagaatgacaggcgctactactggtggcggatgctggtcaagcagcgtctgtacaagcgttcccgcgacgtgcttatccagctggagctcaatgagcggatccagaagctcgacgagacgctggcgaacgtggaagaaggctacgagaagctcctcgagaggttcggcaaccgagaggagcgcatagggaagatggccgaagaggaagtcgatccgaagaaggcgtccatggcggagggtactgcgaatggcgccgctggcagggatcgcacgaagcgaaagtacacggtcatcgaggacgatgaggacgaaggggaggggccggcggaggctgcaaaaaaggcaaaagtctagatgtgatgaccttttttcttttgttttgttttctttcatgccaactgcgatcattacgatctgcaacgtccactgtgtcttgtccggtgggtactaatcatatcatgttatgttatgctattcaggttatcaaacttttgttttactagcttcttcttatagagcaacaatcaatcgctcttggaacggattgcaagcgttaaaagggggaaaaaaaaatcaagtactaagaattatattatgcgtaatgtttactataaattaatatgcgtattgctatatatactagccaacctcaggtacatacaagtatcaacctcacaacgacctcaccaaggttgttgttttagttgatgttgccattccatccatcgaccaataacgcccaaactatttaccttttcctccttcctttgcttgatatcgatacacaggtctctgctgaagattggaagaaacaagaaaaagaaaagattcacaagtagaagatgggacaaggtggccagccaccagatctggagaaaataaagacagggaaaaaaaaacctagtcagtatagataaatggaagaaagtgccgatatcatgtcaaaaatgaaaagcacaggatcacgagcggtatgaaggaggggcgctagaatccaaagtatccagcgtttccagagtgagcgacgaagtggtttctagactcatcaagctgcttgatcgtggtgaattcatccccactgacgcgacatgaggattgccgcttatttcttcgtaacgaggaggtgggggttgtccgggaaaacgagcgagatctggatcgtcctcattcccgacgagctggcccacgaattcgagaacacgtctcaagcctaagatttcggcatgcatggtgccttgctgggtctctgggtcagggaggagatcgtcacggggctgttcggtgcggtcaatctgagggagactgtgactggaagaagtgctaggtgcggcgcgatgtgaccgcccttcccaccattgcctccatcgaagacgccgtgcagccctgttgtaggcacgacgagcccttcgctcctcgcgtctcgccgcgaggtcagcccgacgacgccgaaaagtcggggaattgcggagaattttgaaggcaagcgcggaaacgacgatgacgaggagcaaaatgaaacatgatcggaaaaagtctttggttggagactccaaggagatagatggaaccgtgagataacgggaagactcaattccgatgcctgggttgtcgatctctccttctgaacgatttcgggagggataaggtgattgcagagatgcaccagaagccggagaaggacgatcgtctgagttacatgccgggacaagtttctgcgactccaaagaaccgaatcgatatcttatcgaacgaaacatctcgggtaccgtctgtaacgagaccttgaagatgcaccccaagtctctgcactgttcccatttggaggacagagactggcagtcctctctcaacaggctgcggatcttctcttcctggaccctgatcgcatgtcgcagctcacgggcctcagaccggagatcctgcaacttctggagctcccgttcgattcgatcctcaagcgtgtccggctcaagcttgtgaacggagtcctgagtgtcgaagcgctcggttgtaggcggatctcgccatgcttcgagtgccaacttatcgtctggtatgtctacgacgaatgtggacagtcgaaggatttccggctgttcggcattcgtgaacgaaaccgtaaagcctacccggtcttggacagcaagctcttcgacattgtcaagcgtcagggtcaagacctgagctgtgtgccctgtgggagcgtcggacggcgcttccaagcagacactgcgccaattcgccgacctttcagaagttgctgcatcttgagaaggagcacttggaatcatgccagagcccgaaccttgattcccatcccaatgaacaggcagctctttcccattgaggaataaaatggcatctccgcatgcccccttggcctctctgacactcagctcaaagggctatagtccatattagccgggaaaagaagacagataggcagacagctgatggtgagacaccagttcatacccaatcgtggtagctgcctgaggaacatcctgagcaagacgcctcaaatttgacggaaacaccttgggcatctgttcgcaatagatactatacattagaaccaccatgtgatgacacaaggcaagccaaatggactgacctcgccaccagaccactgagaattcttcagtggaggcattggcgttgcgggtctggagagaagggacaggcaatgcgtaggcgatagcgggaccgagcacgaggattgctgccgtagttgagcagcgcatagcgtctagaagcatagccgactggtgcgcgaccaatttcaggctaacatcatggaggcaaagtcacagcaatggaggaacagccctgtccaggtacatccaagcattactgcagactgatctagatacaattgagggggattcctccgaaggccgaataataatctacaccatctacggagtagtccgatgctaatattagcggagttgaggctgaccaaccgcttgtcggcggtgctggtctccgacgcgtgtccggcccgtggtttttccgagctccattgcggcgggcagcggctggccagggcaggcaagcttggagcatcgcatagagagctgttgtatacggtggaggcgacaacgcttaacagcctccagagaggaacaactgcgttgattgaagttttctgccctctctaaaattactgagcaacctcaacgatcttatctcaagtttggtccttcagagtgatcgtgctattcttgaaactccgttctcaatatggtacgtcgcagctatcctttccgttttcctgcaggaattcgagcctttctggatcaccgaatctaactggattgattagttgcctctgggccttttgacagccgcgcaaggccatccgatgcttgtggaattgaagaatggggaaacgttgaacggacaccttgtcaactgcgacaactggatgaacctgacgctgaaggaggtggtgcaaacaagtcccgaaggcgaccgtttcttcagactacccgaggtctacgtgaggggcaataatgtgcgtgacaaccgctccgctgcaagaaataagtggtatcatcgactcaccgtgtcctagatcaaatatctccgcgtcccagaagagattctagagattgtaaaagaacggcagcagaaccagccttcgaatcggggccgtggtggtccatcgcagcgaggcgacggcggcaagggagaccgaaaccgtggtggaggacgaggaggacggacccgtggtcgtggcagaggttgagcctgcaaggccaataaagagtatagaaaagaacgaaataagatacccctgcgacaaaagctctgaatggatgtgcgatgatacctttgggcagattagacaagcatggtattggcgtattgtggctgcgtaccaggagaagggcggtactttctgggactctcgtgtaagcctttggctctattttctgaaaacttgcgtactctttaaggattgtagcccaattaatccggacatacaattacgacttctgcggggagcccgaatctcttaaatcacgtgatcaaatataaacttgtccagctgcagtggttgcaagatggacgatttaaagtaatgcaccgcgtcagctagagatgcgacgagggaacctccgcgtcgatggtttgtggtactgtctctgtccgtcattctgccattcatcgctaagacagccatttccctcgttcgtgtcaagacgagcatctccgacaagatgtcgtgtctccaatcttgccccggatgcggcgcccgggatacgacgctacagcagtgctgggggaagtgatacagctcagacagaaagggccagtgaggaattatccaaaaaccacgccagagagtcggtctctagcgcacaatcaccaacgtcggccgaagaagtccagcagcaacaagacgatcagccgaagattcggatcacacgctactttgctcgagatccagcgctagtgagagtcccccagagcataagccagaaatcaacagaagatttggagaattatctcaaccaagtgacttccgaaaagtcgccaaaaatgttgaccgtgactgccgtcctgcgcgccctgatagcggagcgacacattgagccaaaggtgcggcattacagagccctgatactagccaacacagacccgagatatggatcgcccgaaaatgtccgttggttgctccaagaaatggaggaaaatggaatagcagcagactcgtcgaccctccatgctgcattgcaggtgagaatgtctctcatcatttttgtggaacctcttaactgatatcccggtcttgtacaaggcactcgccgttcaccccgattacctcttgcgccaggaagtcctccgtacactccgggatcgatggctatctctcagtccaactggctggcatcaccttgttgctgggcttattcgagagcaacagttcgaattggccctggatcaccttgatcacatggcgcgaatggagatccctgttcaaagctggttacatgccctcctggtttacaagatgtgcgaactcgaagattttgaccaggtctacgacctgatgagttcgcgggccagtcaacagcaggatatttcaatggacttgtggctgtatgttctggacgaggcaagtgaggctcttcatcataagacgacgagatatgtatggaaacaagtggtggaattgggatacttgaacccgtcgtatggggtgtgcggcaacgtcctgacggttgcgtcccgtactggcgataccgacctggctgcgtcggtgattcgcttcctcgtcaagaccgaagtcccactgaccctagaggactatgagaagcttgccgaaacccatgtcatggctggcgatctccaggcggcttttgatactctgtgcttaatgcacaatgccggtatccaactggaagaaagctcaactcgttccattcttacatacatggtgcagaagaaactgaaaccacaacttgcatgggaaacgctaaaacgactgaaagcgcagggaagaaatgttcctgttggttgtgccaatgttgtcattgagtattgtgagcatgagcttgctcgcgaccagggggctgtagacaaggccatcaaattctacaaggaactatatgatctctgttccagtcctgcggatgtcacgacctacaattgtcttatttccttaagtcgacgtgccaagcgctctgatgcctgcatgtttgtcgtcaaagaaatggctgcgcttggggttacaccagacataactacgtttgaacttctcatcctcatgtgtctggagctggaaaacttccgctctgcctacatgtacttccaagacctcctagacagaggctggacgctgagtgacagcacatgtgctaagatccgtgagctctgtcagggatctgaagacgaatttgctgttcgattggtgtcgcacccaatgctcagcattcttggataatgatttagatttggggcgtatactccgtagattggtggcggaattctgagatacccgaaacgcactgactttatgtatgtataatatatctgattgttttcttacaagaatcccttccacagatatgctattcccaagataaatcgataagtatttaataaatataggttggagtctcgatcttgggttcgagtccgtgacacgggatctacacatgtgacatcatcccgcatggaccatcgtacctgaccaacagcgagctaaattaaacgcaaggcccagaacacagcttaaacctggttcttactcttcaatacatactgaccaattcatgatctattgaatacaaagaaaagatagaagaatggagttgtgtcttcgatagaacttcctagtcgacagattatacgacaggatcgcagagcgccgatgcggcgactgcgtgcctagagcaagcaacccacttaatcagcccgtgcgacatggttcgttttggaggttctatagagagttactgttcaattctgcagtttactaggaaaaatgttctaacataattgcttgtaccactggcagacatcctttctccgccagatcgtggctggtccgcgattgcaacacccagaagctggtctggatctatgctatgtgacagataatcgtgagtactgtttccacatatgatgctaccattttgtctctttcactaatactgtgtgtttcttggtgatcgtagtcatcgcgacgtctggcccctcctctacatacccccagcgtgcctatcgtaatccgaccgacgccttagtgcgcttcctagactccaaacatggagaaaattggtacatttgggagttccgggccgaaggcacgggatatcctgattctgaagtgtatggacggatccatcatttcccatggccggaccatcacccgccaccatttgcgttgatcccacccatcatggcgaccatgcgaaattggctacaaggagcagacacagagggcaagcagcaaacaaagggggaaagggtggcggtggtgcactgtaaggcaggtaaaggacgcagtgggaccgtcgcctgcagctatttgatcagccaggaaggctggaagatggaagacgcgctgcaacggttcaccgaacgaagaatgaaagtcgggtttgggaatggcgtcagcattccgagccagatacgctgggttggctatgttaaccggtgggcgaatcaaatggacaacgtctacgtggagcggccggtggagatcctcgagatacacgtctggggattgagggatggggttaaggtcgccgtggagggctacgtggatgaaggcaagaagatcaagtgctttcatcttttcaagcgcagtgagcgcataatcgtcgatgacgggaagaccgtcccggtcagtaatccacggagggtgaatttgcagaaagtgacgccggcaagttcttctctatcgtcctcatctataaatatacccgttcggccgacagagactgttacatcaccgacgtccccaggtgaattggaaagacctccgactactattaagcagatatctgctgtcattttgcggccgagccaaccggtgattctgcctacatctgatgtgaacatcgatttcgagcggcacaccaaagccgcttacacaggctgggcaatggtgacgtccattgcgcacgtctggttcaacgcctacttcgaagggggtgacaagcacgactctggagtcttcgaggcggagtgggactctctcgacgggattaaggggagtaagatgaaggggacgaaggctcttgagcgggtgaaggttgtatggcgatacccttcgtccacgcaggtcggagtaccagagccggagaagaaggggaaggaagcaaaggacgctgcgacacctggaaaggtcatctcgctcccgaaaccaggagaacccgttccagagagccatgctgcagattggcgtggtgaaactgtgacccgtgacgaagactgtcagtcctcgcgggatcagaggaataatcctttatatccgcccgtcccttctagggaaacctcgcagaagaagagcaatccactcttccggaaactcagcaggaagaagcctggaaacgagcccaacggtgtggctggtgagagccatcctaccggtcggagagaccacaaccacgacgaccaagccgttgagcttgctgggcaaaggactagggctgcgtaaacagaccacggcccgtcgagatatcagcctcgcaacaagcgtcgaggacttgaaacaacaggaggaagaggagcaagatttgggacagaaggtccaagaggagaaaagagagaaggaagaggcagacaccgatatggagggcgtcaagtcttacttcaaggatgagaaggacaatggcaacgtcgtcaccacagacccaaagccagagacatcgcaaacagcagcggcagcatcgtctagcaagggttgctccgatcctctagacggaggacatgatctgctctccccctccccttgaagaagggtggaaccaacggatttatgccacttttttttatcgaaccacgtatgtgtccagttgttgcatacgaggaaagaacacacggaagatggatggtttacgggcgctcagcggtatggattctttttttttttcgtacacacatacatcaacaaggtacatacatgaggcatagtacatagatattaggtgcctaggtccctaggtacctgttattatcattatcattatccaatgatcatagatcaactgactgactgattgattgattgaattcgattcaaacaaccactccaacatcaacacatcaatacatcatcaatcacatgcataatgcgtaacgtgcatccaaaacgatgaacctcccaaaaaaaaagagaaacataaacataaccccaactgaattgtggagagtaggggaaaatgtactgtactgtacttattcaaacacctccttttttttaaaaaaaaaatctaaacccccacgcctctatttttatgcaatgcgacctttttttttttgttctccttcccatgtatatttcttttttttttaaccattccttcttcctttcttttttcttttttttcccggtgagtctttacacatgcatgcctatgcctcttcttctcttctcgtttgggggggaaaaaaagacagaaaagatgaacaacagccggggacggaggaaaggatgagtcatgactgatgatggatgtacttacggaaaaaaaatcccggggtatatgtataataaagagatcaagaaaataaaaaaaaccatggtgttttctcttttatatgttcgcgcggtcctttgctgatttgattagaacggcgcgaattcctcctgcagtcgccgtcgttcgtcttctagttccttgagtttcgcctccagggccattctctccctccggagacgatctcgcttcttccgctcgtacacgccgcgcacgacgcgcttcacctgcgcttcgccctcggcgaagttcgccttggcgagtcccaccaccgagtcgatctgctccggcgtgtagacgaagttccacgtcgagaggaagtcgtccacgtccgggttgatcgagctcggcttgggggctagcggcttcacggggtccgagccgtcgttcctagcggcatcggaggatttggctttggatttggctcgtggggaggatgatgtcgagggattatgatcaaagtccggcgcggacggattgggcagtagagggaagtagaccacggcgatgccggcgtcaggctgcatgaggcggaagtcggattcgcggtggtctccgtggctgggatggaagagccgtttcgatggtggtggttccttgtccgatatcttttcttccttcgtgcccagccatacgttgcagtatgtcagttcgcggttgtcggcctccaaacgctgtgtccggagggtcaggtcattcgtgtccgaggtcatgagtgtgtcaatcatccgggacttgtgctccgtgcgcgagtctttcgcctggacttccgtgagtttgtcttctgcagccttttcgtctaggttctgtgtctcgcgcagcgtcttctccgtgtcctccggctttgtgtcttcccttggccatcccgcaccgatgggccagcccttgattcctcgctgtcgtgcgtagccatccacgaccgacaaccaattttcctgcttgatgtcggcagatgcgtcaaaggcaacgatgatatccacgtttctcccagggcgcagaagtgggtagatcggtagattattactcatgcccgcgtccatcaaccgcaaatgtgtgctgttgaagatggactcgggacacgatgcaggcagcttgtccttcatgccaagcacatagttcggtatggaggccgggtcaatgggatggactcgaatcaactccctgttccgtccttcaatcagcgaatcaatccctccaaagccggcgagccccttgaccgcaggtcggatctccttgtagtaatgggacagggtcgcgcaaaaggcgctgccccaaattcccatcagcgctggaagccgtaactctggcaccgcatatttgttgggaggcacggtattcctgccttcgttgaaatgtctccccactgcccacatggggattcccgcattgaattcctcgcaaaagaactcataaggagtaaactcgaaccactgaaaccatgcctccttcctcgctgcttccttcagcttctcagctgcttgtttgcccttcgtttcctttccttccacggcggggatctcgtgacggacggcggtgtaaatgggcagagggttgctgccatcatcgatgtagtctcgctggttggacagcttcaagtcccggtctgagaggtccagctcgctgcggggaaccagcagtcgcgcacccagcagcaatccgtatatgtccaccaagccaaagtccgaatccgggtcgcccttcaacttctccaccagaccacagaggaggtatttgttggtcggtgcagtcgtgagcagattcaaagccttcggaggaaaggcaatatgcacccccagtcggttcttcaaatgctcgacgagcttgttgaagtcccgcccagacagagacgagttgtacagagcctgcagccaacaagtcccactcacgccggccgtgtacgtaacgcaatcccatagaccggcttcctgcgccgcgaggtacgatccagtccccgcgacaagagcccgtagccctccccccgaaccgcacatggcgataatcgggacatcgtcgggatggatgtcctcctccttgaggtctagatatctggccaacgccttgacggcatgcatccggcgcttgcgcaggaacgccagttcctctcgacaaaggtcgtctccaacacgaaccgtcgcattgagggcaatctccgggttgatgtccacatcgtgcgcttctctccagatttcgtccgcaagagacccgggagccatcgacagctctcgttggagcttctgcatggtcgccggtagatatcgcacccagtcgggcacaatgtagttcttgatgctgccgccgatcccagaccactcaattgacccgaaagagtcccttatcaccccaaacttctgtgtaaatgtcgcccaggcggtgcccttcctcgcgggcccttgcggcgcgccattgggctcagtgtcgggggagtccgtcgtcgatggttcagcaggaggctcgcttgttcgtttgttgtccacatatcgagatgacgaagtggaaaacgcgcttctttgatcccaaagttgtgttggcccgtcagcgtgcagtcgctccgggcccggagaatatccccaaccacaccatgcggccaagaatgcggcgggagggaccgtccagcgcaggcgcaacagccttgcgctgcgcatggtcggcctggcgtagcagagagacggcagcttcgaggacgatggcattgagggtgtcgcatggagctggcggcggcctgacgcgctgcagaccgtcgcctgcaaccaacgcatgcgttcgcggtgcctggcgatccccaacgacgacgtctatgacgacatgatttgattgtggatgggaactgttgatgcctgaggcacaagcgactgatcgggcttagctgctgcagctgcctcagatccagcactgcggagagcagcttgggccatcgaactcctagcaatgccatcgtcccagggccagtctcctcccagcgtcctcaggctgtgcgcatacagccaaagggttgcggggccacgagcctctctctgccgcgcgcgtcttcttgcgatgacctgacctgatcctcccctcccctcggcgacttagcacgactccgcgaccggattgcgatcatggtcgcccccaggaacgccgcctatgcggaagagagcgcggaggtcgaggtgctctacgccaatctcgacaagcttaaagtgctcaccaagaaaatccaaggctcgctggaccggctggagacgagcggccgcgtggtcaaggaggccatcgggcccatctacagcaacacccagtctctccagatcaccaacgccaacatcgaccgcgtcaatgaggccatcgataagctgcggaagcccctcgatgccaagggccgcgaggagggcaccattcgtgctgggtaggatcgtctcttccccaagaaatccaattatccatgtcgctgacagaatggaagcccccagagcgctggcgtgtcgcagtatctgtctgcaatgaagcggatcgagggcgcgctgaagaacctgaccgcgacgaacctgcgagctaatcaacaagccatcgccgacctcaactcgctgctgaacacggggagtgccaaattgcaagacctgttccgctccatgctgaagcaggatgtcaacccggtggaaccgctacactatctgacaaaacgtgagtcatagtcacctgctgtcactccttatgtggactagctaacgactggtccaaagagctgcctttccctcccatccccgaggagaccctatctgagctaggacccatcgccgctgcaatcagctcggcggcctctgccgcggcccaggggcaacagcgccaaggcgaagaccctgcgattgcgatctatgccgaagtccgtgggccgtatatcacttccagcttgcagaatctcgccattgcgtccgtcaatacagtcaagcgacgaccttccgatggcccgtacaagcaaggcacaaacggtattggggtgtatgccagtgctttggagggggttcatcgtggtggagcatgaaaacattgtgaagatatatacaggcgaacagcagggtcgagcgcttcaggcaacctgccgctctgcgatggcggagttttccaagacgctgcgtgaactcaaccagtacatcaaatccaatctgatgacggactgcttcctcgcctttgagatcatcgagatcgtgacggccatgtcctatcgcattgattccaagacaggagaactgaagagcctgtttatcgaggcccttcggcccgtgcgcgaaacagccaaatcctctctctcggagctcctggaggaaacaaagcggaaagcagcgagtattcctgttcttccgcccgacggcggctcagtgccgctggtgaacgaggtgatgagctctttgacgaccctgacaggttactccggtccactggcgtccatcctcacgtcactgggcgacgggaactggcgttccacatccaatacagcaagcaatgctcccctggatgtgagtccggacagccagacgctattctcgcacttcattctggacatgatcgaggccctgatcaactctctcgaggctcgcggtcgggctttccatcgttccaaggcgacgctgggcgtcttcatctcgaacatcttctgcattgtcgatcgctccatccgccagagcccggaactgtcccgctatctttccagcccggacagtatcgcgcggatcgatgcgtttcgcaaacggggcacgtccacgtatctggaggcctggaaagaggcgtcacagcacctgttcgatgtgcaatatacctctcgaggcgcccgtcctacatcaggggggcctgtcgactcggcggcgatcgtcaagtcactctcgtccaaggacaaggacacgatcaaagagaaattcaagtcgttcaacgccgccttcgacgaactggtcgcccggcacaaggcactctacgatgggagcgcgaggtgcgcggtgccttggcgcgcgaagtgcaggccgtcatcgagccgctctacgcacgcttctgggatcgctaccacgagatcgacaagggccggggcaagtacgtcaaatacgacaagggagccttgtccgcgcagctacaagccttggcctgaacttaaagacacaagatcgtttatttcttgttcaaaaatactcgctgatatttccaaagaactacaaatatgacgttttacacagtttcactgcacttgatgatgatgggtttcttcttgtgggaattatatatcccaggatgttgttatcttgataccataccctatcataataccatgttgatcaacgtcttagtattatatagtaccgattaatttgttgaaatgactcagcttgaatatattatttattaaatagtaaactcgattagtatgaactaattaacatatggctatatttcatattcactataagaagttgtttctgttatcttcattattattactccattcacaaactcaatattaataagaatgttgtaccgccactcagtttagacacttccacgcatttttttcaggaacgtgccaatgatgttagcggtctctccttccccagggaaaaaccccgactcagccaagaaagaatcacataacgtgtcctctctttttcggagtgtgatccgagggttgtcgaaggagggggtcgttcttcgcacattgactgattggcacgtcatggacaggagcgtgacaactcaaagttgtgcggacgagaggagagaaaatttgagtagggcatcaacccaagagaagaattctgaagaaccggatcatatacaggttatcgaatgaagcataccgaatgacgttgacgacaatgcaatccattatatgtctttcttagactgacttgcagctgaagaatcgaattcttcctcgtcatcgtctggcaacggaacatccatgactcgttcccctgccttttccagcatacggcaactccaggtcctgacacccttgtagacagcctacaatcaaccgtcaatatctgcaggtgctatgtgctagatggcaaagtcactcacccaaaggaaactgcccacaccaataagcaccaccacccagctgatggaagcaactcgactcctgcccgtcgttctaccaccaccgaacaggccggaggtccggatattcaaccactgccatggagacgccgctagcagcactttgatgaaagacaaaacgcccagggatgctagtcccttgacaaagtgttcaagccaggatgttttttcctccagagggggcacatcaaggacggggtcaggttcccagtcccagtcccagtcatccgtggcgaagatggttcccaaagggtccgcccagaaattaatgatggggtcagcaatgaaaccaagcaaaaatatagtaaacagcagtattcctaatgtcagaccaatttgtgtcgcagtgctactgatacatcgagcccatgtcatccgctcgagccggtactggaacttgcaggtcggacattgccaatagttcctcttcccgtagctggggtctgcatgtcgccaggtacgaagacagccttcatgcacgtaccgggatgtccccttacacttgcaaggccgcaaaagtcgacccagctccgggtcgggtgattcatatgttacccgaggcgatgactgcagaaacccaggaagatgctcggacggagggtggaaggttggatagactgtttccaaacagatgcgacaagtccgcggaggataatgcttcttgggcctgttcgatgagcgctcagtagagtcagctggtcgaccgtcagtctgagaatgcccagagcgtccagcactctgggcagcaggaagattctctggccatttccaggactgttcgaagaccatgcttcacagcgagaaaagagaactagtcagatcatgcaacaacagacagaacgacaaaaatacataatcacgtaatacacaaggcaatctggaggtccccctgctgcatgggaggctgcagggacatggttggcgaaattaaaatcaaaaaagaaaccagaagcttcgctgggcgagatgcttcgtttttgtgcacgaaagctccacatcgccctaacccaagagggtcaccgccttgggcgcttggcgctgccggacaccgcgtcaacacctggccgcctatcaccttgctactgtctggacctgccctgtccttcgccggcctcaacgctgcttcttctccttcctacctcttctctttcttggctttacttctcagaagctctgttattgtttgtaaccattttctgaagcttctgacgtttaactgagctccatggcggaccgttattcattctctctaaccactttctcccccaggtgcgagctcccgcattgccctccagaacgttgacctgctaacaatcatctgtagtggaaagctggtccagattggtatttgattcgggatctgtgatttggtttcctattgtgctgatggttgcagaatatgccttgaatgctgtaaaccagggtgtcactgccctgggcatcaaaggtgcgaccctaggaaaccggcgaccttgaccgtctgtgtcgctgactatcgtgatctgcctagccacgaatggagtcgttcttgctacggagaagaagtcttcctcacctctgattgataacccttccctctccaagatctctctcatcactccagatattggcatggtctacgccggcatgggtccggattaccgtgttcttgttgataaggcgcgcaaggtctctcatacgggctacaagcgcatttacaacgagtacccccctacccgaatactggtgcaggacgttgcccgcgttgttcaggaggcgacacagtccggtggtgttcggccctacggagtcagcttgctcattgctggctgggatgagggcgttgagccacagacggatgaatcgaagcaaggagagactggatccgagactaggaaagttacggggaagacaggcggtatcctgaagggtggtcctagcctgtatcaggtggaccccagcggaagctactttccctggaaagctacagccattgggaagagtgcgacgagcgctaagactttcctggagaagcgatacacggaaaacctggagcttgaagatgcgatccatatcgctcttttgactttgaaagagaccattgagggtgaaatgaacggggatactgtcgaaattggtagggcccacaatcccgcttcacctggttctgttaaggtattaatgatttgtttaggtattgttggaccgccggcggaccacttgttaggttacaagggtgtcgaaggagcccgggggccgagattcaggaagctgagtaaagaggagattgaagattacttgaccaatctatgaatgcgatgtttgcgtcgtttatgccagttcacgtctcgtctaactgccttgtaatataatagactatgccaggtcttgcttcctgcattcaaggaatgaacgcggtccgttgggcactggaagatgtcgctcactcacaccacaagtggttcctgcggtgcgactccgcaggacgtaggatagagacatcgctatgcagcgatggggaagtctgatatacttcataattcaagtccgagggctggattctagggagattttggcctccttatttgaaatcgaatattgctcagatactgacatgaatgcgaggttagctattatgaggagaccagcgttggcaattgagaagttttgcttaatagaagactctcggactcgagattacccagctagacagcatgttttttatagtaccttctgtctctatcagctgtggtacttgatcgcataggattgtatcacaagaatttgcagatccgtccactctgctctcctctcttttccattatcttttcaatagttgaagcgaaaatgttggtttacagaatacccaaagtggaaattgtggacaacatgcggggcacgctgcctaaactggccgcccgcttctttatcagatgccacaacaccaaggataggacaaagaaacacaagatatgtatggctttggaagtacattacgcagctcatatcattggctaggctgaggccagccttgtttgctttcccatttgagagacaagcattggtggctgctactcgtgccaatcgtgtttcccaggttgccccgcgatagaatggcgaggtggaagtaacctgtagcagctgcaacaaagaaaatcctacgacgtttaaatgctcgaagccccagtccacgagtttcaagctcatctgaatcccttcagacacaatgcaagggaacaagatcttagtcgacaacaacggtaatggcattatagcggaaggagcgaccacaggcgaggctgaggcgcctgttggggaagccgccatgacaatgcccaagccaagaggttatcagaaggaaatgttggccgagagcttgcgccagaacatcattgttgcggtatgaaaatccccgagttccctggagaaagtgcttctggctaatgatttgacctgcgtttgatatccagatggatactgggagcggcaagacacaaatgtacgcctctacattacacgatccatgcttccattgtctcgttacattagctgagctttctgattattagtgccattatgcgaattcaagaggagctgggacgctgttctccaaacaaggcaagccatctcgttctggtctgtactgcttttgctaacaacgcttttctatagcttgtatggtttattgcccccacagtggctcttgctgaacagcaacattcggtcatttctcagcagttaccggcttttcaaactcgaattttgtcgggcaacgacaacgtcgaccattggagctcgcaaagtgtttgggatgcgattctcttcaatatacgtatcgtcgtctctactcctcaggtgctcttggatgcgatgtggaggggttttgtcaagttggaccggatagcattgcttgtttttgacgaaggtggtgtaaaaaaaaagttcccagtagttgtttgtacagacaattgacttccatttcagcccacggttgtgtttcctcatccccaacaaacatgatcatgcagtacttctaccatccagctcggaaatctggggaaacaactgaactccccgcgatccttggattgaccgcaagcccggtcacaaaggcgaatattgcaggcttaaagtacgttgtgaatcttgagagcaggagagcctatgctgagaatttacagagaaattgaagaaattgaagagaacttgaatgcaatctgtcgcactccagtgatacaccgcgaggagcttttgaaacatacccaccaccctgaagtatccacagtgatatataaggagtacttggaggagccctccgagctgttaaagactctcgaaaggcttcttgaattgacgttggtagatatagaaaatgacccttatgtcatatccctcaaagagaaaaaggatgagaagagcgaagcaaagctactggaagttctttcttcagggaagactctctgtcggaaggagctcaagggacttcgaaatcgtgctcttgtgatccaccgtgaactcggaccttgggccgcagacgtgtttgtgaccacttgtgctgagagattcatcgccaacgtctctgcagcatctgaaaacgacatgtttgccgaatgggaaatggaagaaaagatatacatggtgaaactattttctcagctaccaccctctccggtgagcaggcgttggggaactcaacccgatgtgttgtcccacaaagctgaacggttggttcaagtattattagagtcatataacccaggatatcgggttattgtctttgcccagcaacgcagcactgtattgatgcttgcgcatcttttatccgtccacccaggcatgaagggaatagtgacgggtcatttccttggatgttctagcttcgctagtcgcaaatcgaatattactgagctatctgctcctcgagatcaaaaggatgcgatcgacgatctacggattggaaagaaaaacgttcttgtcgcaacctcagttctcgaagaaggtatcgacgtatcagcatgcaacgtcgttatttgctttgatccaccgacgaatttgaggtccttcattcaaagaagaggcagggccagagacaagaaatcaaaatttattatattccttgatgagaatgacaacaacaagcaagcaaagtggaatgcaatggaggaggaaatgagaaaagtatactctgataatatgcgcctgttgagggaaatcgaggagaaggaaaatattgaagaatacagtccggaatgctttcgtattccgtccacagagtaagtagtataaagcctatatacgagaaaaagaaacgagtttatcttactgaccgcacagggccattctcaactaccagaatgcacgccagtacttggcacatttctgttctactgtctcctgcccctatactgagaatcaaccggactttgttatatatgaggatgacaaagatctggtcacggcgaaggtgattttacccagctttctggacccatctcttcgggaggcaaaggcaaaatccagttgggttacagaaaagatggcaaaaagagacgctgcgtatcaggcgtatttatcgctttacaaagcaggtctggtgaacgacaacctgatgcccattcattgcgagaaatacatggacgacgccgagccgactgagaagcaagtaaagcttgtccagatatcaccatgcttcgatccctgggttgaaatagcccacatgcgcaggtcgaatctacctctcttccagaccaggatagagttctcatcggacgttctggtattgcctcagatgctcatactgcttccgaaacctttgccttgtgaattgacatttgacctgttttggaatgaggaaactactatcaccgtatgcctccggccggtgaaagatggctgtctggatgtagaagcccatcacgctgcggaattttcgtatatattgctgtcttcagttttccagagacgaatgactcccgatcgcagcgatcttgttacattgttttggccgaaactggaaccttcactcgccaacgttgagacctggctttcgtcaataacaggcacattcatggctgaagagataatggacattcataatttggaaatgcttcaacaattagggttggctcggaatatagagtatggccgccgtccctttgccattgagaagactctatacaaggtgaccgtggatgatgatttcgtcagcggtgatggtactgctcaatcacgagaggaattgcatctccaaggcactaaaattccgaaacgcactgattttctacacccggtagctggcgatgcaaagtcgcggttgcatcatactgctaaacaatgcgtcgctgctcgttcctgtgccatcaatcggcttccggcgacgtactcgagatttgcacttttcgtaccttcaattacccacaagatcgaaatcttatttgtggcagagaagttatcacaaacaatccttgctccggtgggctttgagaatttacatcttgtggttaccgctataagcgcttcgtcagcaagagaggcaacagattaccagcggttcgaatttctgggcgacagtctcttgaaatttcatacttcggtccatctgaccgctatgaatcctatttggcacgagggactcctatcatgcgcgaaagacaagattgtctccaacactcgactgtcaaaggcggcccttgatctcggtctggatgcgtatatcttgaccaaagcattcacaggaatcaaatggcgaccaagctatgtctcagacctttgcgaaccccactcaagaatgggcaacaagagggagttgtcaagtaaagtgcttgcagacgtggtggaagcgataattggcgctgcatacctcgatggcggtatcgaaaagtcgtccagatgtcttcctatcttcctgcaggaagtggaatggatctctatggatggtgcgattgagaaactctaccagagagtgccaacaccaaatgatctcgtttgtccctcagtgttgcctcagatagaagcactccttggatacacgttttccaagaggatcctcctggttgaagctttgacacatccctgcagcaaagatcacactgtgtcttaccaaagactggaattcctaggagattcggttcttgaccacctagtcgttcaagagttgttcaaatctccaagagaaaaatcccatcaagacatgcaccttatgcgaacgacactcgttaacgcggacctcctggccttcctctgtatgaacctctacctggaggaggaccgcgaagaccctgtggagcagggccaggctcatctctcaacaattcgcaccacacggaaggtctatctatggcaattcatgagacattcagcatcttgggaaatcacgactgcgcaacaacaggcactcagaagatacgaggatctttgtgacgagatccacgaggcgctggctcactctgccatgcacccttgggcattgctgtcgagactcgaggcagggaaattcttctctgacctgatcgaaagcattttgggtgccatcttcatcgactcacacggctctttagacacatgtcgacagtttctgcaccgcattgggttcatgtcatacatgcgacgtgttgtcaacgaggaggttgaactgctacatccgcggaatcgtctacagcatgctgcgggatcggcgaaagtagatttcaatacgagggcggaaagagtacagaatggggcgggagaatccaagctccagtggacttgcagtgttcgagtgggtgacgaggatatcatcgaagttggcgacgggttgaatagagtcgagatcgagaccaaggctgccgccgtcgcggcagctatcttagaggcgagggcagcagtggagccggttacggggtcgagcgagacgagccctgatcagattccaaaccactcgtctgggatggatctgaccgctgactagacacctttgatgcgatttctagaaaacggagcacatgatgtcatcagcaaagttctcagttttggacagagactcggaggatttttggacagcagtgttctctgacttggttagaagacctgcgcccattggcttagcatgcaacggaatacgagctgcatgtgactttgtgggtttatggtcgtcccttggtgctaacactatcattcttacgacttcaattggcttcccagctgccaaggaggcccccaaagcgggacgactgtgtggcttgacgcagtgatcatgtggctgcggactgcaagcctgcagcctgttctcctaagaagcaaaaggcgattccactaatgccggcgacaagtgaagctattctgtacctgcatactgttcaatgcgatggacaaccccatttgttgctttctctacgagcgcgtcgttgcccagaaagtggctttccttggcgcttggcccatgataaggcctgatagtcgcatgaccaaaggctccacaggggcgttgtgccgctgtgcggcctggtaagcgtgcatcgtgaatgattcaaatttgaattgttttggactatattcttacttctttagttcttactgtgcgtcatgattcatcactggccagcttgctggatgatagggcagtgggcgaggccgcagcgaccaaaagaacctggaaactcacggattttcccccctaatccgcagctctaggcccataacggaaggagtcgaagaacggcgtgcgacgatccaacgcccgtttccgaaacggggcgatccgggggcctttttttggccgactggggcagatgcggggaaactaagcagaggagatccggtttttacggcccctgtcgaatctcgaatgtcgatgacacctgccacgagtcaggaaggattggctagttgcgctcgagccgctggccgaatttaaaaacaaactcgacatgttttggagtcggccgataacgctggcctcgtttccctgttggaggaacttggtgccggcgccgcgcaacggtgcaacccaacctcgtaaggatcgaagcaatcgatccttttcgtcaatagtccagcaagagtcaagactaccggggaataaacttctgaactattggcgatacgatgtggctattcctatgcgggagaacgcaggacagggcctgcccaagttcctggtgcaaactgcaaagagctaaccagatgcttaactttatagattaactttgtagggcgtgaattcgaaactcaagcgcgtacggccaagccttaaaggcctaaattaagcgagcaggatggaaatggaactcatacgatcattaataacattgtttggcccgttatttgtacgtactggacatcctacatacaagacgtccgcaagtcatcacctccttgctctatcctcacgctgtccattcattccaatgcttgtctgatttaccgttcctttcttctcatccttttcaggatcgccttgggattcctaaggactggcggcatttgttttcccgatagtatgcattgaagatcggattgggaatcggttcgccttagctagaaactgtgaagacgagaaatcggcattgatccagcagaactacaccttgtttcgggttggagttgcagatcatctgcgtgtctgccatttttgtttttgtttttcttcaaggtggattgtgtaacaccgcataacctgagtaagctccgggagcttcgatctaccctcttgctggtatatcgtcatctctagcgtgctcgtccctcgtttcaaacctgcgatgccgcaagttcagctgcttgcgatgaaatacaaccgagaggaatgcaggaattgatggtggctgccaacctcttgaagaaggactgtttcagtagcccgcaagaatatagaaagaatcagcattcattcgcgattctatcgacggttctatcatccgtctcattcagcaaaagcaatgtcggcctcaacggacgggcggctggaagggatatcgggagcatttcagagccagacaagtaacgtccggctggctcttgtcgtctttatcatcctgtctttgtataatgtggtcgaactggtggttctgattctctcctccttccggcgacgcaggggactgtacttctggagtcttttcctgtctgccacgctgggcgtcttgccatattcactcggctttctgctgaaattcttcaccaacatcagtccttatatatcggtgacggtgctgtcagtggggtggtgggtgatggtcaccggccaggggctggtcctatattctcgactccatctcgtcctccgagaccagcggaagcttcgccgtgtgctctacatgatcctggctaacatcctcctcctgcacgtccccacgaccgtcctgacctatggatccaatgtcaaccatccgacttccacctttatcaatggctacaacatcatggagaagattcagatgacgggattcaccatccaagagggcatcatctcggggctgtacgtttaccatacggtcaaaattctgcaatccgcctcgcagcagaaacgggagaaccggaggattatgcagcagctcgtggggatcaacgtcctgatcatcatcatggaccttgcgctcctgggtctcgagtacgccagtgagtacgcgatccagatcacactgaagggcgccgtctacagcctgaagttgaagctcgaatttgccgtcctgggcagactcgtcgatttcgtccgcctagcccgtcacgcgaactcggcgaacagtttccgtctaggctccctgcggtataccgctgaccagggggcaggggctccatcgacgcgggcagatgatccgcatttctatggagaaaccgtcgcggacgctgtcgtgaggccaccgcagaactcgagcgaggagcagcttaatatccctttggggatgattctgaccaagacggaattttccaccagcgtcgagaaaagaccgccgccggaatatgatcgagatactgacgggtgaggcatgtgattttattatgctatgtttgtatagtagtttcttttttgcccatctctaatgtgtatatgaattaatacgtttacgaggctatcctttgtttattctctttttgattagcagatatcacgatctctgctcggtatgatgagtaagaggcgactctgccaatctctaagaagaaaatttgccagagttttgcggagaagtcaaaattaaatgagcaccaaagccccaagtccatctgtctgctgtccagcttcgaggccaggttctgctgcatccacctcgactcacatgccaaaattgtggtcatgcccacggagcagagaatggtccactacgcttctgtaccacccagtcgaaaatcaagcttgtagaactttgcgtgatggccagctgcatcgtatcgtatggtcgttgcgactacttcggctgcgagtgcaggtttgtctgaccaaagcagcctgcaagttgtcatccttcccaatgtccacttccccagctgtaccacatctccagggcgataagccaatcggcacgacctcatcctgcccattgctctcggaatggcagccactgcatgcgagatgccgtctgtatgtggcctcttgatggcaccggctggaaaacgctactctctttggttggctgtcacaagtaacggctccattgtctctgtggtcatccagtggcaattgcaaagctgaccatggaatatattcagtacacactacagcatctgctttatcgggtgtttgctgtgtacgctggctagccaatgatgggcggctcggctatatttcccagccagcagtgcggatacggaacccagctacatacataatgcatgcgatgtcttgatgcctagactgttaaccgcagtgctggacttgatttctgaggatccgaattgacgttcggacgatgacagaaaagatgcccgggcgtacggacaagactgtacgagagcaagctgctccttttcgggtggcgactatcacaaaacttcaaagatggcagcaagcaacagggccatcatgaggttttctccctccagacacactatttgcaattgccacttatccagacgacaagaggatcattcagcatttatcaggacgacgcacagcaagcggcctctgtcggctgccctcgcttccccacccgttctgccgccggagctctaacgcgcgcactgttcgggctcaattggctcgagaagatggacgactcgcctgcaaacccccgcttccctcctgcaccgtgctcggccagcaatgcactttcgatgtcacgatcaacgtggcccgcctcgacgtccaaagcgtctgctcggtggctgccctaacccatgattaatatgatcgcctatttgcacagtgctgccaccatccaccactgcctgcccacctccttctcacctgctccctgcgattctcccattgaggctcaaccacctccactgctgtcagcaacggtcatggccgacggaagcttagcttgagagggtgtgtgtgcgtctgcgtcttatggactgtcgacatcgtgggatgctgtgggactgaagagagatctggaatcctatattttcaatatgcatttcgcagaccagtgactgggataggctctcctgtgagtgtccctttttctgctctttccttctctccccctctgttctcaatttgtcgaatcgacgttataataattataatttttttctgcctccgtctggaacggaccttgttgtggagattaattttcttgctatttgtattttgtattttgtatttttttttaaaaaaaaatatttttgtattctacttccctgacaagtgcgttctatccctgatatctgcaactggaagcacgaatattgacagcacaatctagtggatttttcgtcgcttgcggcttcgagactgagtgcttgggagcaggatcgccctggcggattttccgatcgtctggcctcctattgtctgtctgataccccattggaaattcaacagccacgttcccgtcctcgtgtactgatatcctcggcccgttctatggtggtccacgacggtgccggcagaggtacgaccgtaaccgatagtccaggaacaatgacgccgccgtccagtgcagttcccagtctctccgatggttcaagctcgccgtcctccagttctatagctaccaagatggcggcggggatcgaagggactaatgtcctggagaacgatggcacgggcaacctcgtcgctccagaaagaccaccgactcaggcaatttatcattgcctcttccacattctcccttgtgactacaaagcggatcgcgtggacgagtggaaaacgcatgttctcagccacttccgaggcagtccacttccgtcgacggctcgatgccaatggtgctctgctaatttcacccaagttcaaccgggtagcgcctgggatgccatgctcgagcacgtggctcacgaccactttgagcgaggagataccctcgcgtccagccagatcgacttcgagctcatgcggtatctctactgttcaaaggtcatcactgcggatcagttcaaggcggtccagctcccgccatcgccctccagccccgcataccgtcaatcccaggactcagtccgggccagaattggctcctcggacgagccgttctgctctagttacagcccacgacgggagaagaggatgcgccaacaacgacggggtatcagtgttgcatgagcgagcagataccagtgcagccctttgataaggaggcgatcagctgaggatcaacatcttactgagtcccggattcaacttcaattcttccatttgtattgaccataaccttcaagtatgacatagcactatacacggctgattcgcaatgcaagggcgcagatagcaggtcctcatgtgtcgtcattcgacgcatacaaagggcatgccatgctgaatgacaatggccatgaaaggctacaaccgcgagtcaccgcattagtgccctttacgtttcattcttgtcgatttaattttctttaacgtccgaatcgacttccctttttgctgtaaggataaacagacacgttttttgttttttttttttaaatgccttttgcctcgcattgaaattgacatttacttttatggatacaaatgggaggattagtttttttcagtttcgtttcgagtttgtctcctcattgcaattcgagtattttcttggaggaagtctgctttgttgccacgcgatacccacggaccttgcaaacaagaatgtttggagccttatgaagatcgttgcgagatcgtccaggttgtggagatcacggcagcggcaggctcggccaaatcgacattcaattcaattcaattcagtaatgtgcttagtcttgatatttttgaggaatctactttatcaacagaaatgaaaaatcatagtcctatttgaacacgcgtagtaaatgcatcttctgtcgttgagctagcttctttttggcattaaccctcaagagagaggcacggccaattcgtccatctggcgtagataagaaacgtcgcaagtccaaagaggatgctgatcaatattccgatacttggacgtgggcgtgtgggcgattcaaacagagcaaacacatcccgcatgatcgccaatggccgcaaggacgatccaggcacctttgctattgctttgagctcaattcctggtttcagtctatcgggtctgattctgcggaaatcagatctttcttgtctgatggcataatcgaatccagctccattcttttttttaccagaatgatagcgttatcttcctcactgcggacttaggaaaacctccctcctccgacgaaaatatcacactgcgttgcgcggttctctctctcttccccgccctcacctccgcaaggaaagaaatcttgacacagcgaccttttgttccgccgctgccatcatagtcccgagtcatggaaagactctcccttcatgataatcccgccggggcaccgcaattgacgaatgcgcaccacggtcatcctcctccgcagaatgtcgccgtaccgcctccgcctccacccccctcggggcatccgccgatgatgcctccccaaggccctcctcagctacctccgcagatgtttacaactgcagctcagttactggatttgacagatagtgagctcccccacttttactgtatttggaggaggatggttgtgacatcccccttctggagatactggttcttgtcaatgatggatgtacttcattgcatctgggtccgatcaacagggggtttacatgtgtttaagctaggaattttgttgctaactcttgttatttttgcctagagaaactcgtgttggtcctccgtgacggaagaaaattgattggagttctgcgaagttgggatcagtttggtatggattgctggccatccactgtccatgacaaccgcgtgaatcatggttctgacacgggcgcattgtcacagcaaatctggttctcacggacacgatagagcgcttgtatgctggcaacctctacgctgatgttccacggggtctttaccttgtacggggagagaatgtcctgcttctgggagagattgtgagttggactctgcccggtctttccattcaagcaggtcgatctgtcgacttcctgctggatatccatctcctcttttgtgctgacataggtgctaacgctggcacaaggaccttgacaaggaagatgatattcccccgtttttgaccagggcatcgcctcaggaggtctttgagcttaagaagaaggaagacaatgagcgaaagagtcgggataagaagcgccacgggaagctgcaggaccttgggtttgagcccgaacacagcggagaggtgctattctagcatgtcacatgtgtcaggcatgctattttcaaaagaggcgtcttgcccacgtttatagacgacaactgaatataatagcggggaaaaaaaagagtcctcccagacaggggatctcagctcctccggttttctttttttttggagggggtcgaatcgaattcaaccccatacgccacaaaccccatgcagatttctctgcacacttgcttcatcgaacaaaccagctgtgatcaagaaggatcgacagacatctacatacaatggtcgctggtttcacgatcgtattagtttcattgtttcttttcttttctttccttatttattttatttcggttttttaaatcacgccttcccttccacggagcgtggcagaaccaggtgacccaggcgtcgcagaatattgtgaaatgcttcgacctgaggattgaattgattgagatgaattggaaatagaaaatagtggccgctgggtcaactaactaggtagatttctctgatgagaaatacatcgacagacattgcattattattagcatcaatggggattaatccccattcttctcgttctgccttccctttttttttccctcaaacttggtaaatagatgattaaaaatgaataaaatacagggtaattacgacagtctcttatgttctgttctttttttttgcggagagtatgaatccgatactgtagaataatcaatcacatagcagatattgaaggctttttttttcaatagttcccagtcctgaaaagctgatgatcatacagatacatacatacaatcatctacggatgagacgtatgtgcagtacatacatccgatgaatatatataggcagcacgaccttagctaaggtcgccatattaattagataactggtcagacctctctattggggtttgggacagtactatctttgaacaaaacgcccaattttcaatttctggtgggggaaaaaaatttttctttcttggatgcagatttaaccaagaaaccaggaagagttgttgtacagtacagtacagaccttgcaagacatttcacaattggatttggattggctttcgtgaaaattgctcgagcaggttgtttgtactgtacctgcttcagtatatatattatatatatatataaagctacctaaacttggtgaacggcaatggtgaccaggtggacaccccagaagccaaggcccacgcctgcagacaggttctatatatatgtgactatcggacatggtgtctctttttattttctcctacacctttcctttccttgtttccttctgcttcactaagtaggtacctaaggttcttaagtcgtagcgttaccccatatagattagataggtagagggctcactactcatgtgaccttccagtcgcgttatggccaacaaccataaaatgttatttttcttatttctaggaccctttatctgctgatttttttttaaaaaaaataattcccaaacattagcaaaaagaaaagggaactgctgcatcgaccgggagtcgaacccggatcgcgtgctatggcacagccttttatggaaggcacgcgtgctaccgctacaccatcgatgcatttgatgttgtaagtgtacagaaaatcttcctttcttacagaaatttatctgctgatttttttaagaaaatcagtcccaaacagccaaaaaaagactgcgtcgaccgggagtcgaacccggatcacgtgctctcggcagattgacgggattttttttggaaggcacgtatgcggaccgttacaccatcgacgctatctgatagtgaggtagtaaaggaaccgagaaaaagaatttaacaacctgctgcagggcccagggatttctgtgaaaaactgttttcggtaaaggtggggatgtggggcggaagataatgtttttaggcaggaaggaactgtggcacccaatactgtcagagacctgacaataatacaggcagaaatttcacgctttgcagaaggtagggattggattgatttgtcatagtatcaattagaaaagaaagatcccctactaagttgcggcgacattcacacagcactcatgtttggcccatatgaatgaggaggtggtggagagacaagaagccctccaaagtcttccaagaggtgatgaaatctagacttggacactaagccagtaatatgtaatgaagatcaaaatataagtaactcacagttaagtaagaatgtgcttctgtttttttcccctccgacgctgtgaataatagcgccatggaaactgcagaaaagctttgccagacaggtgcaacaatattaagatgttgactagcccacaatttgtttttcccactgggtagatatttttcaagagcttgagctggtaatgtctggaaaatgtatgtcatccacatctcttctccgtgtttcttcttgattatgaccttacaagattgcaagggtgacaaaagttgattggatgtcctctttactatcccagaatgtatacatttaatggaggcttttttggcgtcttcgaaataattgattttggtgatcagtaattcggtttttcagatttattgatttcccaacgtaaaggcagaaaagatccttgttattatactcccatagaatattcatatatccctgctttttcaatagtctcagggttcccatcaattgatagcaagcttctcaagattcagtcattttctttcttagatagaatgtgataaaaacttacctctccaaattgaaggacccagttcgacatatttctttcactgctgcacataaatctttatttttttaagcagaatctcaacattctctttgcggctctttctaggacgtatggcatacccatcattcattggtctttctaaatttgtcctggccctctgctgtttgctcaaggaccagtaaaatagagtagcagggacgtcatcatcattgtctttgttccactgatgttgtttatagatggaggtaaattccttcataaggcggtctgtggtctcctggcgtaatttctcctcctccttagtcttattgagatggtggtctggaaagaggtttgtatcgatttccattttaaaacaatcaataaaaaaatggtattaggtcatcatacagactggaatggacggtacagttcaggtatttgtctcttgaagctttcgagagccgtgattgcttcctttgttagcatgatggagtgctgaatctcagtgctaggcaagaaatgtagccataaatctcatagaaaagctcttggaataaatatctatctagctggtaaggcatggtgggtgcgcgccgctatcgatagcgattagtgccgccaagcctgtgtatcggcggtgaaaattattattatcggaaccgctaaaaattattatctccgcttcccacctcgtgtgtgctgccaccaaacagcgacaaaaacagatctagcgtcgaacttctcaagctgcctcgggggcgttcgcttgaaggaaaccaaaatggcgaccctggcggagaagttcgacaagatcaaatcgcccaacctgcagaatcagcgccatgtatgtttctctaccacctccgcactgtctccctcatgaagtttaaagtccgcattttcccttgttcaagctgaccagtgatctgatggatgatggatgatgctagaccgcgattgtgctcaatgctgttgaggatacgctgcgcgaccaaaaggccgatttctcccccgccgcgtatttcgctgctctcctcgcgctgctcaaccaggcgctctctagtgaacgtggaattgtcaacaaagagctagccacgtcggtggtctatctgctcgacatcaccgctgactacgtccccgctcccctccttcgttccaagttctcccaaatcctgaccaacctcgtccccgcccttacactccccgatgtcgaagcgccgctgctgcgaccctccattgggtgtctcgagtctctgctggtggcccaggatgccgctgcatgggctctgccacagacccagatcggcccgcgccgggcgactgccggtctgttgagcttggctgtcgaccaccggcccaaagtgcgcaagcgagcgcaggaggcgttgatcaaggtcttgaaaaaccctccgcccagcccatccttggaccatccggcggcagacatgtgtgcggagacggcgctgcgcacattgcatgacagtgtgaccgccgcagggaagaacaagaagggtcgccatgggccccagaatcacgaccccgcgatcatccactccttgcacctcattaagacggtcgcgtctgcatccggcggctggccgagcaagaagatcgagcctctggtcgagttgctcatgaatgtctcgcgttccagtaacgaatacgtcaccatggcggctttcgaggtctttgaagtgattttcgagggaatggcagacgacttctcttccgcgaagctgccacggcttctggaagcgatccaggagttgaaaccggcgcagaacgactcccagcttcttccaccgtggattgcggtcttgtcgaggggttacgacgtctctgcgcagatcaacccgcaagagaccttcgagaagctgccagagctcttcgagatggtttccgcttttctggcttctccatcgcaaaacattcgaatttcagcgtcggaatgcctcatctcattcctcgccaactgcattcccaacagtgtcattctggagccttccgtctacgacgagaagacgttggagaaactggccaaatacgcgtcggatctgctttctgtgaaatatcaagcagcgtgggcggaggtgttcaatgtctgcggcgcgatgtttgacgcgttcaagtggcgctcgtccccttacctcaggaatatcgtcaaaacgattggcgaaatacgtggaaacgagtcgttccaggggaagaaagaggcagatcaggtccttggtagggctgtgtatgcgatgggccccgctgaggttctggaaatcctgcctcttaacatcgcccaacagaagcctggccagcctggtcgggtctggcttctgccgatcctgagagacaacgtgtcgaataccaatctcgcgcatttccgttcggaattcgtgccactgagtgaagcgctgtaccagcgagttctggagtacgggaaggccgaaaagaccgtcgaggtcaagatcttcgagaccctcatccaacaaacctggtccattctgcccgggtactgtgagctgccgctagacttggagaaggcgttcgaccagagcttcgcggagcttctctccaacgtcctctacaaacagacggagctgcgcgtcgacatttgcaaggccctgcagaatctggtggaatccaaccaggcgattctgtcgctggagactgagggcgatgatcttattgtgcagcggcgcatcacaaaggacgctgcgaagaagaacattgcccacctcgcgggattttctagcaatctgctggccgttcttttcaacgtgtatagccagactcttccgcactacaggggatacattctgcagtgtatcaatgcttacttgagcatcaccccggagaaggttagtagccagacgactttccccatatccagacagaagtctaatcttgattcatttacaggaacttgacgagacatttaaccgagtcactacaatgttggaatcggaactcccttcagaggaagaggcagccaagaaaggcaacctgccgaaaggaaccggagacaaaatgcccccaacgtctcacacgttgatcgaccttctcatcgccatgtcgatctacctgccacggtcgacttatgggaagctgttttcgctggcatctgtgatcctcaatcgccaaacgtccgatccgcagttgatcaagaaggcatacaaattgattccccgtctcgcgacgacggagcttggacggaccgcgctgagcgagcgcagctctgagctccagtctctgatgctggcgactgccgacaagaccccgtctcccgcacgacgggatcgtcttcacgcgatccacgaactcgtcacgtacttgccgacctccgacctccacttcatcccctcggttctccccgaggtcgtgctcgggtgtaaggaaagcaacgagaaggcgcgaagcgcgtcctttgacctgatcattcacatggccaaaaggaccattgatcctgagcggaatcccccgggtacgaagattaggaattccttggtgcctcacatgccgaatgattcgcccgatgctccggcgacgctcgaagagttcttcaccatggtgtcggctggtctggctggcagctcgccacacatggtcgccgcgtccgtcacggcgctgtcgcggttgttctttgagttccattctaagatgtcgtcgcaagtggtactggatcttgtccagacggtcgagctgttcttgacgagcaacaatcgcgagatcgtgaagtctgttctgggctttgtgaaggtggctgtggtgtgtctgccagaggacatgctccgtccgcgcctcgactccttggtcccgaaattgatggtctggagcaaggaacacaagggccgtctgagaacgaaggtcaaggggattctggatcgactcatccgccggtttggtgccgcgatggtggaggccctggtgggcgaggcggatcgcaagctggtggtcaacgtcaggaaagaacgcgagcggaggaagcggaagaaggagaaacgcgaggcggccgaggaagaggaggacgaaggcgctgctcctgctcgcggcaagacgttcaccaacgagttcgacaaggcggtgtatggctcggatctctcgagcgacgaatccgacctcgacgacgccagcgagatcgagatcgacgaggaaggccgcatccagagcgtctcgtcgacgaagaagggcaaggccggcaagggcaacaaaggaggagagcaatacatccgcgaagagtcgccagaatccaaccctctggacctgctcgctccggacgcgctggccagcatctcgaccaccaaacccagcgtgcggttcctcaacacggggcccggagccaagaagaagcgatccgccaaggtcgatgccgacggcaagctgatcctgggcgacgacgaggacggagacgtcgacatgaccggcgcagcaggcgatggcgaacagcccgaaagcggcatcaacgcatacctcgaggcggtcagcgggccgaatgccatccgtcgcggccagaaaggccggctcaaattcaacaagcagaagaaagatgacgagatggacgtggatggcgaggacgatgacgaggaggagaagacaaaggctaaagttgcagctgcagccgctgctctcgcaaagaagaagaagccaatcgtcagcggacggcgcggcctgggcgctcccaagagtcacggtcccagcggatcaggcaggattgagaagcggcggaacattgtagcgaagaggagtgggaggggtagtatacagattgggaatcggaagagatagacacgggcatgagggaaatagagttggaaaaaaaaaacgaagagtgaaatgaagtgagcaagaaaaaacttttttttttaaaaaaaagcactcacacagagaaaaaggaagaagaacgattccttcattcatgacgatcaagcatgaaagaaaagaaaagaaagaatggtgacaacattttatatatctccatcctcatccccaacaaccttatcaggtctgcttactgagattttgtatgcattgtttatacccttttttggaacatatttcatgcatgtaccttaccttgccttactttgctttgagcttgagtaggtagatccatttgaattgaattgaattggattgaatacaataaagtggattggatttattatccagagctgccgagattggtatgtgcatattatatactatatgtgcttctctttttttttttagaaacatgcccttttattcattatccaatccaaggtctctatctatccgatggatagatacccagacagaagaaccacatacgatctcgctacatgtaacaggacataatataatgatataatcccccaaaagagaaactgacagatatcccaccatccatccatacgtatgagaactaaccaggcaggtaggtaggtagatagccatcgtaaataaaccatccctcatcacaacaagacaagacaaagaaaagaaaaagccaatacaactccactttcgccggtcatgatgctagcgccctttcctttttttttttccaacactccccaaagcaagcaaaatccaatccaatcaagggtgatgaaaaaccaccaaaccgaggttcgttcatacagggttcatgaaaatggtataatagtgaaggaaagaaaaaaaaatcatggctaagcaaatacccaacatggtcatcgctttcggcggctcttgccaagccatttctgccaccagccattcacgccgagaacggccgcccgcccatcgtcccgccgctccgtgccgtccggattgcccaggatcatggcgaagatccagaagaaagccgcggtccataccgccagcagcaggccgagactcagcagcggggccagcaggaggacgaggaccagacgggctggtgagaatatgtctgtcagcgcaccgtcagaccggtaagggtcgtggtgatggtgatagtggtggtggtgactcgacggtttttgcgccaaccgttcgtggtattctagcgctggaaccaggagctggcacagctggatggagaaggatgtcgatcggaagaaagatgtggggggacagaggcggagaggagaggacaaggtcacgaagagcaatgcgaatagcgtatagagacaggtaccaagagagaagaggggcacaggcatggagaggaatacctaagggttcgagtcagcacaacaagcgactgttaacagattcatggacgaatcgtgaactaaccaatgctaacaccgcattgggctctttgctgtaggaaaatttctccttggttcctgcatagacagtcacggaactctgctcgtcatggcgcacgcttcggagactctgtcctccggacagctgtgagggacggctcgcccagcttgcgcgcccactcccgtccttgtgggaatgcccttcggcactcgtcacagccccgttggatccagagccctcctccatgtgggatgccagcgtgaaagaggcagagccggcggttttcccggggtacgactgcaccgggtccagagcggcgcgcggaatggagtacgagcccgtcgacgagccggacagggatcctgtcccttcaggtgaagaggcttctgagcccaaacggtgatcctcaccgtcacggtgatcaaacgaggagggccattggggcgactgcttcaatgagacccgatgagcggctgggggcagcgccgagggagagacatgatgcgggatgacagtgacaaactgatcggagtacgcatgttcgaagtaatccgggtggtagctggcggtgggcgaagacggggctctctcatgcagcgacatggcgatagatctggtacaagccccagatcgcccgaatcggacgtcagataaggcttcctcggtggcgtaggttgacgatatcaccaacacacacgaggcaccgcagcagacacaggcgacgagggcagatgacacgaagataggcggacggacaggtcaatgcatggcttccgcagagcgcaggaccgtctgggcatctggatcgacgcaggcgccgcgtctggaatgaagggaggacggggatggtggtacagggaccgcggagaggggttcagggcacggtattatatcacgcagcccgcagacgggaccagcggagacgagaaagggaggagggacatgaggaaggaggacagcgggaaagatccagagaaaaaagagatcgagagggacaaagagaggatctcagcggagaggctgtcatctcggcgtcttggactttcttgggctttggcgacgccaaggatgagcctaggtgccgagcccttggcgttgtaattagcaacggcagacggccagcatgcgcatcagaggggaagcattattctcccgatgcaggatgttggatctggagatcactcacacgaaaagaataggaatggctcgtggcagggagcatcgtcgcccgtcaattgcaatctgcctgtgctgcgttccatacggagtaatcatctgcaccgcaggggcatcccatcgtgtagaatggagagttccagcgttggcccgttggattcgcccagcggaagcgaactgcgttcttaccagccgtgacgataccgatgccaagaccccgtcttggcgcggtccaccacatcgcgttcgcagcccgtccggcgctgccattggccagacaccgcgcgcacgcgagcgatccgcctgcgtcgcttatccttggcagcctcggcaataccggccggcgctgtatcgataccgcccgagcaatccgcgaccaacgcccgttcgaatgctcgataagagtggtgcttggtggtgtagatcgcagcgtgcaaagagagagtactgtcttccgtctctctagactcccgatgatgtccttggtgggagcagacacagaatccgtcgacatcatcgccaggctgcggccagatggatgcatgcgtcgattgcccagccttgccaatgtctcggcattgtccaatttcttgtctgccgtcctatcccaagactccagcccattctgtgactcatcaaaaagtcttggagctcataagctgggacgtccagtgcctaccccgaagacgtcatgagtgtgaacagccggacagtctggcagacgatgatgatgcatccatgagcgatgacagatgcactgtgccgtctcggataaacgtttgtgctgcccgcctccgcttccctgtgggggaacacctgatgatcgtcgttctattggcactctgcattccgcgcgcctagactttgcagtgttggcattattcttggccgggatgatgcatccagtggcagtttatctcgacgagaacatgccgaaaaaagggcaaaggaaagaaaacaaaagaaaggttcgaattgaagcccaatttcgcttacggaattgccaagaatcggtccacagactggtcgactgacttgatagaggtgagaaatttgaaaattgaaaacgtaaaaggacaagactgctgtactattggaattgtttactcgataacagataaacacatctagagaagtttccgcatggccagacgtcgattggacgaagcagtcgagttcaattgcgctcttatcatcattctgtcatcattataaactctgtgataacgcagccacgcttacgtgtagaacagaaaataaaaatgctgagaaataagtacgaatcagccaagacagacaactcacacctttgccactagatacaaccctaattaattggaccaatacattttagtgctctgctattgcctcaatccctaattcctgggataaagaagagagcattattctaatgcagcatagctacctagctagtagacaaagcagactgcagtacttttttactaaaccttacttagcaagttagccctaatccctaataatacttcctgtctggatagccaaggtattccatgcctacctacgtacgtaatctatggtcgtctcagaggatgttccacgtgggcggtgtggagaacggtgaggaaagcggggggttttgaccggcagtattttcattattttcctcttgcggagtttcacgcccacctttcttcttcctttcctccccagcttgatcttcctgtaaataatctcctcatagtgtcgatatagcgaatgagattgggtttgtcacaattcttaaaagttgtctttttatgttgagtttgttgtcttacaaaaagaatatttcttaaatgtttctttaaaaagtattgtttactagtggctaaccaattagataaccattatatatcgatttctttataatacttatatttcctatatatagtaaagctgtcaaaaacatctaagaaactgttagttaacggttttctaaccccaccttggcagtacgggggtctctaggaggtttggtatagtgcgagcagagtacaaaatgttgacgcctaaacattctaacatttggagcactgtagagatgttacatatgtctaaacaatttcccttacctcttcttctacttgaatgtccctctctgcggctgcgctctgcctgtacaccacgtgataatgtacaaattgagaatggcgctaggccagattgtagggctaggacctgatgtctcacgcccacaccagctggggatctttctttgttctttccttccctcagcttcagataacttagcataactgtcactaagattgatttctgctattgcttgagctgttgcactctactccctaactctggttaagcttgattcatctgcatccattatagctttccacgaaaacgatgacaggctacattgatatcccactcacaaaggaagaggaggaagaaatcgatgaaattgccaatgggcccacttgggaggaggaaattgactgtgtggaacaaaccaactggtcggaggaagaagctgatgagccaggtgagggccttggacatttcaagacagcaaaatattaactcctagtgaccacaaagatgacttgaccccagctctttacgtaaatgggtaatttcacctaattgcaagcccggatctacagaggtattacgacaggttgaagccagctattttccgggccaatagaattacatcaggtgtttgttttacctggaaacagatcattggcaagggatcagtcgataaatggattgatgatatctggaagatcacagtaaatgacttccgatatctgctcggtcgatcatcgccaccaaccttggacgactttgaaaaactagaagtgattgatacagcgcagctgggattgtaccttgcactgattacgcgggatgatggttaaggaaggaaatatctttatgttggttcagcaacaagtcccagaggccttgcacatcggataaaacaacatcagcggaagtcctacagttctcaacaagtttaagtcatagcacatttcactcctcttcctattagagcgaagaattgacttcgtcatctcctatgtagaaaaagcggatcattccatcacagattgctcaaccaaaaggacgtccaaggagccagaaattcgtgacagcgggtcttgcatccttcgagaaccctaacgacttggacagcgttatgtacgaaagggaaacaattgtctttgcagaggccatttatacacattggttatatgaatttggaaaaaaggactaggcaaagaatatgatgtcttgcccatttgtccctggaagccagacatcctatcctacacgggtgcctgccgtttttcgcctctgacttttccagtgccagggaaaactgtaacccaatgtcaaaggaacaaaggcgtctggcattaaatgtggcaagcaccaatcgacgaagacgccgaaccgatgaagaaaaagctcgtgaaagggctcgacgcaaaaagaccgctgctttcaggtgggtagccatcaaacgatggaaggaaaataatcgcctacgacagctgcgaaagaaactcgaaaacaatgtcaagatgcgggcagcccgtaaatgtttattctgcagagctgcagcccacgatatcagaacatgtgatgcacctggcaaggaagttttcatgaaaacaaagtggaaaggtcgttgtccgagaaaggaacgcccaaagggccaaaagagtgagaagaaagaaacccggatccccggttgcgctgtctgtggggatccaggacataatgtccgtacatgtaccgatccggctgcagaggagtggcgttacgacatcagatgctctaactgctgggagaccgggcacagtgccttgacctgtccgcgaaaaggcgaggagcaactatccgaatcgctcccgagacagtgaagtacatgagcagaactttcgtctactgcccagggttcccttcgtttgttgacccagtgattacatggacaggatgtttttatcttggtttgtttcattgcccagggcttaagtgaaagtcgtggctcaaaaggaaaagctatgcttcatggctgtaaggaaaaggttctcttgaactgatcggaataataagaaatttgcgggcggatggagcaaccgtcatctttagcagtttttgccacgataagaaagttatagtttgcggtcaaaatacagagattgtattcatcgaccgttttcttcgactgtgataatagcggttaggattgctgaagattcgaagaaaaaaaaatgaagacgatctatcgtgactggcgaaagaaaaaaaaagtaggactagatcctaaccgataagaataaaagatgatgattagagataatcgaaaaaacttagctagggcgtcaattagattctatcctttttttttcggtcttggattatcgtttgcttgttttacgacttccagatgctgaggattaccctgtgttcccgtcaatcccacgctcgtggagtagtaggttgcaatctaatgtttttgattttgcctgtgagcacttatatatacatgcagttcctatttccacatatatttacaagaaattggcaggaaaaataggaaaatatggtataaatctactgagaaggcaaaatagttaacttctcagccgggcaatcatgtcgctaacgaccagcacatctttcttcagcgcctcgacgatctcgaactgtgcacaccttttgcctaaactcatatccttctttgcccaatagcaccgacgccgccctgaagtcatcgaattagcaattcaaatttgacctcgaagactgacatccaaacttacggtatcagttcatcgtccgcccaaagtcttccatacgactgctcgccaaaggtcgtgccactaaccagcgatcgggacccttcttcggtcgttcgtagtaagaaagcattggccaaggcccggacgaccttcaggtctgttcccacccgtagctggactcttggtagttgaccatgtagatgccggcattgagcatcgccacgtccagacggtccagggttgtcgaggcacggtgcgcaaagtcccggatgctgtcgtacgagttcatgtcgaagtgccatacttggacgcggtcgtcgcgagctttcatccccgtcgtccactcttcgataactgacttggcgtgatggcccttggtgatgacttgcacgcccagcgcggtgaatttggcggcggcttcgaaccccagaccggattcgttatcttcctctgcatactttttttatactatggcttgctcagggaattttttttaataaaaaaaaaaggaaaaaaaaagaaacatatactgcacgcataattgacagaacgcctgactttacctctctaggacaggtaatccgcaacaaatagatagatagacaggtgtcaagcgaaagacgacgaaataacagaatttttttctgactagactaaaactcctagcacggcatgaagaaaccgtgatacttagaaaagaccaacgagatgaggaatcggggctgattttaaaccatggaccacggacctcactccctaagctatggggttctctccttcatttgtcttgggtatttgtctcgtttcaactttcaagggtgataaaatcaatatcatacgggattcctacggtcctacctaggtgctgacaataatatatgtgtggggtaggaggacgatgaacggacagatagacaaacaatctaccatctgtagggaatcacagattcaattaattacacttgccaaaaaaaaaaagaaaaagaaaaaaaaagaaaaatatgttttgttttcttattataattatttttttttgcgcagttcgcttctcatcatcttatatgtgtctgtttgttggcttttatgaattgcgtaagcaccagctgcaggaggatccattacggcttgacttgtttctcttttcagcgaagcaaggaaaatcaatcaacaatagaaacgaaatgtgttgctttactgcgttaatattcctggtaaaaattgtttagtatatatatagtatataaatatagacaggaaagttagagtcattgctcctctaatcagatgattatgatcgtaaagcccataaataaaaaattggccaactccttccttcacttattgatcagtagaaatagttaatcatgcaataacatcactaaaacgaaccaggacagagatgcggatggataaattttaattttcctattgcccgtattccgctaggattgagcatgataaggattctttgatttgtagcgccttgaccttgaccttgcccttgaaacttgtgtatgtatatacgtggacagtgtggcagttgtaggaaaagaagcaaaaactcaacttaggtagtctaccagaagttcatgcatttgtctacgaaagaatccaaaaaaaaatcctgcaggctacatagatttcttctcaatattgttgttctatggaagaaaaatattttttttcactactaattgagtaattattagcttctgcaagacatgatctttctctgctgagtatgtacacatgtactgtacgataagatagggaaaataagctaggcaatttctacagcagaagtagtagtatagccaagcataattattgcttcggctctggctcgttcaaaactcatgtctgattattattctcctaattgaagttattggctatatattgcgatgtcttcttgtcgttgctggcaagattagtactactgttctggctcgtagttacagtacttccttcccatttgtccttgcgaggactaggggtacatctgcggttgtagtaacgccgagtactccagacatatgatttttttttctatatatagattgcatatctagcaatggaaattttttcgattccgtggaaaagaatatgttgaactggattcagtggattcccatttgagcaacctcagatgccgctaacccgatgcatcaggcgcactcatccacgctaaccagatgagggataaaggtcacgggaccagcttaggtaaggtacggtactgtgtctgtcacactgccagttggcctcctcacgtctacagccttagatgcggctgcatctgtcacaagactcaagcaacaatcgctgaggaataatcgataggtaagtaggaacaaagctagctagctacctaggtaggtaggtagggattctgtaggtagcaagtgagggcgtatgtatgtacagtacatacagtacaagagtggagtggagtggagtccgtcaatcgacggaagaagaaagaaagaagatctatgcatcatgtacggagatagatgcatgcatgtatgcatagggtgatctgctagcatgataaggtatgcatgtacctacctcatccggaatatctcgggaatagcaaaaggaaaaaaaataacaatttaattcaaaaaaaaaggttacggacgatgactttaactaattcgacctgtcaaggtcgaccgggctggatcgcagaaaactcggaaaaggcgcgccccaaacggttccatgggaaaagaagagccagagaaaccgccttggggaaatttgccctggtcacaccagtaggttacgtagtatactgttcatgactctacctgcatatgtatatatatgtatgcccggaatgataatttttatttttcttttaaatttgtgtgtgtgtgtggctagtgggtcttttgacgtcaatgggggtcaggtgacggtgtgactcgtggaccacactgacttgacaggtgttttgtttgccggtttggcaataaatagaaaagaaaagggtatggaaaattctgtactactactattattaatattgcagaggtatagtatagttgatatcagccttgaagatatgtaaaggtagtttcttttcttgttcattctctctgtctttcgtgttctctcagcgccatcgcattacttgccaatgtcaaccgtttcagatttatgacgccgccttggtcgcttagaaaaggttacgctgacgaacgattcatctttctactatttttctactatttctactatggctggcgtggtatgcacctgtcttatatagtctagcgacacgggtgattatataacacacagtgcaggctgtgcagcccaacctgtcatgcttaatatcctgtcagcttaatatccgcttgcggagtcagctccgtctggtacctgtccagcaagatgctgcgacatggattggcgcgcagacagacgcaagtgctgcgccgggatgtctgacgcacggctgcgggccacacggagactttgagtctaagcgagaaacactggactggaaactcggagcttttgaaacccggtgtgcaaccctgttccgtccagaatataataataattattaccgttcgtcactggccagcggttgacagcttgccacgatggagaggactgagcgagatgagttgagttgcacgcagccgggctgccacgctaaggcggggcgcgcggaacatttccccgttgcgtattgtagtctgtgcacagatatagcgtgctgttaatcctcgtaaagcgagtgatgatcaaagtgataatcacatccaccagacaggccttctacagctgacccgggtagcgccgctacgtccagcttcaccgcggtcagcgatgcaatattgacagtattatatcaggcccaagcatgatgctgccgtgcgtaatcacccggccgggccagcttttgccatcgtttctttcttgttccaacgtggatggcggttctgcccaaggccacgggtcatacatgggggcggtccacggtaggagagagcatggcaacggtaggccagggaaatgctgcacgcgcgcacaggagcatggaacggtcacagagggaggaggtggatatggatgcgttggctggcgcggtgccatgcagcacgactcgtccgtgtggcgtgggattgaaaacgcaggttgaacagctcgccgcctgtcaaaccatcgagcgcgtcggaccaggatcacccaggcaatcagagggcgcgcgatcggcgtctgatggattgggcgtggtgtgggcggctccaccgccaggaatccacctggcaattggcatgcagctgccgagggcgagggtggctggcagctagggcaaaaggaacacgggaaactcggctgcgtcggaggggggtgtggctgcggtggctggtgctgtggcacagcagccgccaaaaaaaggagaccggggtcacggggccgtgacgacagaggaggcttccgggcagcgggtcggggcgagtcagctggcggagagatcaggtcggaagtccattcttaggccaacggcctcccagggtcgtaccgagccctgacggcaggcgcgaacactggcagcgcacacccggcgctagggctgcacgctggagcagcaaggtggggcccattgcttaatcagtcagtcatcctcatcaccgctgctgtcactcggctgaagaatgtaggcagtcgtcctgtcaatccggccagccttgcatcggtctttgttgatagccggtattgtggcctttatcgacagactggccctggcatggatcaaggcgtccgcagggttggtgctgcaggcgtgcacagaccggggggaaggacacggaaaacgagggcagaagaatgcctgccatggaggtctggattgcccggtcattatctgctcattattgtttcctgggccaggatccatggacccatggacggtgatccagcatccctccgaggcgtcacgccaaacccaaacgggacatgtggctccccggtggggacccccccgtctcctccagggcgctaagccgcaaggagcctaggggcgagattcggcacggggacgctgcccacgggccacatgcgccagccgtgggtgtggccgggcccactgcagcaccggtcactctggccctccccatttgtgttgcaacggaagcagacgcctccccccctgcccggcctgatgggtgctgccgtcgctgtcgcttaacctcacacctctgctctgcctgagatctttgggttgggttgggttcctagccttttctgacgaggtagggactccctgcgccattattagtttattacccaatacagacccccacatccactatggcagggcgcatcaccatgtagcctcccatggcaagtgtctttttatatagaaagtcggaccgacagagaaagccggaatcttccagccagcccggatagctcccaccctcaacattctgaactatcaagtcttctgctgtggacagatcactcgacgtcgcagtctgatagagtgtctgcctgttcaccggcccgagattccaggactctgtcctctgtctccgtagactgtccacggcgtcgtactccgtatcgtcaggagaggatcccagatggcggcggacatagtgtgcccatagcgtgggcagcctaagaataagactgctgctgaactgtccggatcggtgggcgtgatcgtgcttagtcagccgcgcaccacccagatcggacccaccgccgtcgccccctgggctagctaagcctaaagcctgccaggcctccgcttggcgccggccgctgctgctcgcccgtcctccctcggcgcggttgctgctgttgctgactgcgccagaaggtacacaaccactagcgccgcttggcaaaaatcaccgtctcgcgcccgcccctcgaaccccgttctctctcacccgctcatcctccggtcttctcttctgctttttttctcctccagcgtcgctgcgctctcgctcgggaccgtctctcccccggctcctgtcctcctctcttccccaaaccccctctcctacgcatccttcctactctcctcatcggacttcttgtcctgttgcctctcttcctcttcccttttcccgtttgcgtcgcggtcgtggtctccggccgccaggcacgttttcgctgccagctgtggactcctggacgcctccacgcccaacgtctcacgacaggcgtccctttggaatcaatcgcgcctcccctggacttgcgattctttccagactgccctctgttcttttcattcatcgcctgtgatttcacgcgacctgtcgctcaacctggttacggccgcgtgccacgtcatcggaactccgggtcgagcagcaccgtcgtcgaagaagcagaaagccttcggaataccaaggataacgggtcctgagagctagcctctctcggctgtaggacgcaactgcgctcgggttccccagggcttgatttcgttcgaccctttcgtctgattttggggcggctgattgcgaccccctgagaataatcatggcgcatcctcagccatcccctcctgggggcgttcctccgcaccatggccctcttacaacccacccgcaggtcaatggtcatattccagtccagtcgcaggggcagaagggccctccgctgacgacggcacaaaagattgctgccctgaacgagcaagtctggctccagatcggtagggaatctctccatctcacatcaagtctggccatctttttggagctgtcgatgctgaccacgctttacaggcagtctgacagaactcatgggcgacctggatggtgccatgcacgcatatgagcaggcgcttcggcacaaccagtggtcgattcccgccatgactgccatctctcaaatcctccggactcgggagcagttccctaaggccattgagtacctccagaacatcctgaagctggatccccagaacggagaaacttggggcagtctcggtatgtcttttgtcgtgactcctccctgtttaaagtccctgtaataaggaagctgacttggcctttctaggccattgccatctgatgatggacaatctgcaggaagcctacacttcctatcaacaggccctctatcacctgcgggacccgaaggtttgtcattgctgtcttcccttgcttctaatcggttgctaacaatccttctccaggaacccaagctatggtatggcattggtatcctttatgaccgctatggttcgctggaccatgcggaggaggctttcactcaggttatgcgcatggctccagactttgagaaggccaatgaaatctacttccgcctgggaatcatctacaagcagcagcagaagtacgagcagagcttggaggttagtaaccaatctgcaaatgtttttcgacggcttgctgacgagtatggtatagtgcttcaaatacatcgtgaacaatcctcctcggcctctcaccgaagaggacatctggtttcagattggccatgttcacgaacaacagaaggatgtgagtgtcaaaattccaatttaaaccaggtggtcctggtccgtgcctcactgactgttacaccaccagttcgacgccgcacaagctgcctatcgccgggtgctggatcgtgatcccaaccatgccaaggtcttacagcagctcgggtggttgtaccaccaacagagctccagctacgccagccaggagaaggccattgagtatttggagaagtctgtcaacgcaggtatgttgggtcgttccacatgtcgtggtggaagttcgccatcaagagcagacactgatctctcccacagacagcagcgatgcgcagagctggtatctcctgggccgttgctacatggcgcagcaaaagtatcccaaggcgtatgaagcctatcagcaggcggtctatcgagacggaaggaaccccaccttctggtgttccatcggtgtgctctactatcagattaaccagtaccgcgatgccctcgatgcctactcgcgtgccatccgactcaacccttacatttccgaggtttggtacgatctgggcacactctatgaatcctgcaacaaccagaccgccgatgcgctggatgcctatgggcgtgcggcggatctcgatccgaacaacgtccacatcaaggcccgtctgcaactgctccaagcccaactgcaaggccagaatcagaacaacaatgctcctgctccggtgccgcaggatgtccatccacaagcgtaccagaatactggcccaggcgctcctccggctccccaatggagcgcccctgcgccgacgggtggtcctcctccccaacccccggctccccctcgccagattgccgactggaaccgcagcatcaacgaggttcagaaccagcaacaaccgcagacctcaagtgcttatgatcagcgcggccctcccccggcccagcatcccagcccgcgccaagagcctcccaggtcattccctgagccagctcgcagtcaacccgccccacgctctcctaagggcagtcttccgcccccgacctcttacccgccatcgcagacactgcctcaacttgctcccccgccgcctcagcctcaagatcgcgccgctagtggtggtgctagtggctacgctggctcggctcgcggaccacctcctcccaacgctggccccggcgcaccggctggtcccaacggtgctccggctcctgctacttctctgcctccttatccccgtccgtttactcctcccacggagatccggccgatccgggaggatcgtccctcgtctcccggctccacgtatcctcatcagcaataccatcacggtcccagcatgtctgcccagggaggtagcggtaatgggatcgctggcggcgcccctcctcccgcctctgcagtgacggcggctgaggctgccgctcgtgagcgcgaagagcgccccccgtcttcgatgaagcgtggccgtgaatgggataactctgagtctggtcctaccaagaagattgccaatgaggagaatcgcgcccgtctggatgatcagatgaaccgacgggtaactccccccagcgagatccagcgtcgcagttcgtccgaggctcgtcgcgaagaacaacgtcgtgccaatgagaactatcatccgtccgaagcggcgcaccatccccccactttgccgtctattcagcacatgcctccgccgtcaggttcgtctatgcctcccatggctgaagcaccaccttcgtcatccaatcctccgtccggcggcccggctgcgtcctctcaagtcaaagaagagtctgtccgcaaagagcagccgccattgcatgagcctgctgctcgcaagatggaagtggatgaaaactacgacgatgatggtgaggatgagaagaggactggcactggccccaagggcagcccccatggcaacgggaatgccaaccctaacggcagtggagtggtaaatggcagcaaccaggcgtcccaacctaagcaagaacctgccgcctaagcgctgtctgacaatcacggttgagccgtcgcgctcgtggatgatgttttcaacgtggtcgagcgccaaacaggaatagttttctgtgtgatgttcctcaatgtaacattaagtcgctctcgactttttacactgaaatctctgcctgatttcatttcttcttcccccccactgttccgataatgccttttttgtgtaatcttacgagtgtaactggatgccgggtggtgctgttcaatgcttgtttcgatcctctggagagtgtggggaccttgatttttttttcatttgttttttttcccttgttattcgtcaatcatcattctgatcgttttggtctcttttcaccgctgattccccttgacggtctatgttctcatgttcactactagattcacgattcatgggatcgatgtagttgagatgaacccagtcatcgctgttctcgcctggtcacattgcgactggtggggctgtgggatttacgattttttgtttgtgttcttttcattctctctttttgccttgttttttgtttgttggcccctcagatatcgcacgatgatggtgccactatattgcatcaaaaaaattgttctttgtcttgtaccatgacttgacaatggcaggtcatcaagattctgttcctgaaaacagagaatagcaaatataacgatcaatccagtagctagaaaaattccaatcaccgttgttgaatgtttcttgtctgtttcgtattctgtgtaatccgaccgtccattttcggccactcgagtctacgttcatgactcgaaatttcgactgtaacgtaatccaccaccgagctggtcacaccaccgagctggtcagccacaacaccaacaccgagtttttgactattactaccaccaccacccaccaccacctaatggccgatatatctagggaggaacgtcttcaattggcccttcaggcctataaaaagggccaatttccatcaatccgaaaggctgcagatgcatttgacgtgcctaaaagcaccttaataacacgtgtcagtgggactacttctcgcaaagattcaatcgccaattgtcgaaaattgacagagactgaagagaatacactttcaacaagtcatggaccagtccgccgacttcttcgaccccgacaacaagcgcgccgtgcagctgcgggagcgggtcgcgctggagacgctcgacgagctgctcgactacatcctggaacagggcggcagcgtgggcatcctggacgcgaccaacagcacgctggagcggcgcaaggcgatcatggaccacatccggaagcgggcgggccccgaactgggcgtgttgttcctcgagagtcgctgcgtcgacccggtgctgctcgagtcgaatatgcggctcaagctgtcgggccccgactacaaggaccaggacccggtcaaggcgctggaggacttcaagaagcgggtggcgctctacgagaagtcgtacgtgccgctgggcgagtacgaggaacagcacaacatgccctacgtgcagatgatcgacgtcgggcgcaaggtggtcgcccaccagaccaacggcttcctctcgtcgcaggtggtctactacctgctcaacttcaacctgtcgccgcggcagatctggatcacgcggcacggcgagagcatcgacaaccagctgggccgcatcggcggcgactcggagctgagcgagaacggccaccgctacgccaaggcgctggcgcgcttcatcgacgaccagcggaagcggtgggaggcgcaccagaagcagaaggagatgagccatttcccgccgcatccgggcgacagcacgccgccgaacccggcgtacgggccgcgcgaccggccgcgcaacttctgcgtgtggtcgtcgatgatggtgcgcgccatccagacgacgcagtacttcaacgaggacgactacgacatcaagcagatgcgcatgctggacgagctgtacgccgggcgcatggagggcatgacctacgacgagatcaaggagaagttccccgaggagtacgagcaccgcaagcgcgagaagctgcagtaccgctacccggggcccggcggcgagggctatctggacgtgatcaaccggctgcgggccgtgatcatcgaggtcgagcgcatgacggaccatgtgctgctggtcggccaccggtcggtcgcgcgcgtgctgctggcgtacttcctgggcctggaccgcgaccaggtcgccggcctggacgtgccgctgggcgtgctgtacatgctcgagcccaagccctacggcgtcgacttcaaggtgtaccgctacaacccggacacggactggttcgactatctgcccgactttaagctgcaccaagccagtccgctgcagtagctgcctttttttttcgggtcctcgcttcgctcgaaatcatctcctaccgaggcgcatcctactcccagaacggctgtctcagctgtctctggctgtttcaacacttttcatttctgtacagtaataccctgcctatcgcctccccttcagcgtcatttcctctgccattctccatgcatcgtgcgtgaagcacccggcgttgatgggcggcagcttgcttttttttttttttcgtttatttaatatactcagagaagcgcatctttgtattaccaacatggttccggctggcgttgtggtttctttcgtctgaacactgtctatgtttatgtttttatctgactgattgacttgaatggagtggagtttacttgctagcagagtcgtttccatacaatgcattctactttattttacttgtttacttgtctcttgtctcttgtctacttacttgacagagtttgcagtttgctactatgttctgtgttagtttaatgtgctgtatttgtatcggtggtatttgtgatatcaattatagacagacagcagacagcagagcatgagcgtatgtactgtattctatggtgtatgctgtatgctgtgtacgatcttgacatgacctagaataataataataaagagaccttgctatcatgaaccttgacctgaccctaattctgctggacgatataatatacagattacaacattgcgtaatgtcacagaaatgtagttgtgtccatgaatacacgcgtcgtgctattgcagtcaatcaatcagacagaacttgcagtgaattaatgatgctgatgtcaacctgctagatcaatgcatttaattcagtcattaattaattatatcacacggtataaactaacaattccagctctgctaacaccaactcatatatacctatatacctacagtgcagtagtgtatgtacatacatacatactttgtatatactgtctgctcctactgtatactctgtacgctgtgctatatactatatactccgtactatatactgctgctactacgcagtcttctcctcctccttcgcccgctcaaacatatcaacaaaaacatccggctcctccgccccctcgacaacatactttccattgatcgtataatgcggcacgccagtgacaaacttgacttgagacgcctctctcgcctcctgatcgacctctggaccaccctcgtcactatccagccaagcctgtgcctcgctctgcgggatactcccagtccccacagcagctttcagcagcaccgccttatccgtgatattccgctcctcctcaaaatacgcgcggaacagctccagcacgactttcgtctgtacctccgcaccatactttttcccagagaggtagatcagacgatgcgagtcgcgcgtgcggcccgtcttcccgccaaacttgaactggatcccctcctgtgcccccgcggccgcgagacgcgcaaagatggcgtccacgcgccccgctccgccgaatttctgctcgtagtgcgcccgcttgtccacgccggggtatgtaggtccgttcgggttaaggtagtatgcgtgccaggacagggtgaaagtgtcgttggggtgctgttggcggtggagtgtgatggctttggtgaggcggcggtagccgatgtagcaccactggttgatgtcattagtatgaagtacgagtacgtcaggacggtgtagatagatgtgctaggtagatagacagatgggtgaatggaggtggtatctgcttgcttaccggacaaaccgtatctgagacaatgtcgatggtgtacttggtcatggcggcagataataaagctagctcttgggtagtagctagtcagtccgtcaattaatttaatcaattaactcattaattgtttaaaagttgaatgaatgaatcctctattaattagtccatcagaataagaaagagggaagaaggtgggatagaggtgggatggaaatggctatgttccccgcatcttcttaataatccatccatccctcctccaactgccatactgtatgggaaatatggatttcttatttctaagcatgtcgccgttcgatccgatccgatccgctaataatagcgcattatctaatctacctacgtactagttaggtagttaactaactagttagttatctaccaggtattatctaatctgcagcaatcctgagataaaatgatgaatttgttcatgaactgtgcggggtcctgcccgctcgatctcgtttgtccatccccggaaattaaagaaagcttgcttcaattgaagatttttcttttatgtagggttggaaactattaattagattaattggattaattaattgattaattcattaaatttgcagaatcgcgaacttggcatgaaatgtgtatgagctcagaatttggtacagtacagtacggtacggtacctgtcccacaatagccctaggattagtcatgtatgtactgtacaatgtatgtctgctctcaataagaagactacatatcatagctttgataatcaagacaggattctagattagtgtttagcaaggtcaatggatgaatggatcagaacctgtgatcccttatatcaagcctattcagagtatgtagttctaggtctctgctattaaggtaattagcagggatagtgctatattttcctacagatggtcattcttagtgtgaagaaagtatgttcgtacatctacagtacgtagtgcttagttaggatcaagatctgtgagataactgcgtgtatgaacacatgctattctaatactaagcgtatgtatgtgcatccacgcaaatggatcaagaacatttgttcgattggtatgtgtatacaagaagcaaaaaaaaaaaagggggggggtggggggggtctcgtctatatcgactcctactacatttattcaatggtcatgattcttattattaaatagacctagatatagatacagatatgaatttgtgaaattaaggattatcccttctgatgacttcaacatataacatatgatgcgatgttattccagctcatagcatcgccacgcagaggctattcatgatgtgactcctatgcgctgtcctcagattgattcctatctgctctacactatatgcatggagaccttctatgaatgttatctgtatagcatattatcggacgggttatatcataccagctggcgattacatattctacaatcgctttgtgagattgccaactaaagagggcctgcatacccatgaaaaatcggagagccatcagtccaccccagttccggcatgccgggatgagcagggccatggccgaccagccgatggagcagctgcagagatatttggcggacggcagtcgttggaccaggtaggaggaaggccacatgccgacaatcgcctagacagagtcagcgggaagcctgggaagaaggtaatctacctacaccgaacgacaggatcgatcccgcccaggagtactgttggccaaccatatggaggtctgtagacggtgagttcatgcacttgactggtgcatatcatatcataccctctctcagtccgtaaatggcagcggtgctgattgcaaccttgtcaacagcaccgagagtcgcggtgagaaacagctgcggccgtcagctgaatggatcgatccgtttcgaaaggacataaacgactgaccatggggatgagaatccaatccatcttccgcaacattctgcgctcagcctctggcgacagggccgcatagcctgtcgactgggccagatactcggcagcttgatccattccatggctgagtggtattttctgttcggtcaaggggggtgttgcgtcgggaggaggaggctgtttctgatccgccatattgcgtggtgttataaattattcagtctgaaagcaaagcagcaagctggtagctggcagagtggattcatggatctggatccaggagtctcttatatcggagcaagcgtcggccaccgcgtccctcgctatctgtcggaataataaaccatctccctcgatcatcagcctgagcatccatcttgcgtatctctccgcaggcggcggcgccgttgcatgcttatctctccgtcaagaagacagcggagagccagtttgaagttgatgactagtaaggtaaagatagcattaacttacgtaccccaacgactatcatgacccacctgctcagcagcttgtctacatgtattttgcggagaaataggctagcagcatttaactactaacggctagctaagctgaagatacggagtacataattggatgacactaacgaggaagattagaatttagattgtcccggagaggatggtcgatacgacggcaattaacttgagcattattgatttaggtccatagttagggttttttagttttttggcttgcgtttaaaaacaacggtacgtattgtaatgtattgtcatatacagatcggaaataatcaaattttccggacgtcaaaccaaaaagaaaaaaagaaaaagagagagaagagcaaaataacaggcttacatagatgctatcactgtgaaatgcaatataagtcatataatatattagccaacatgcatccatccatcaatctatccacgtatggagtctaattatggacagtattatcattctgacccaaatgcagtaaaacatgcaccagtgagtggttgattagccgaattcgccctttttgtctaggtacctaattagtttgaggcctccagtcctccctccagctctcgcctggaccttccctgcaatatctggaccgtggttctacagaagcttactccctaagtttccttaattcgtacatgtacagtacatacactacagtacatgtgcctggcagtcttcgattcgagaaagtatagacagggatgtgagacttacctagtaccttacttaacattggcattatttactatcactacgtcttgctgctgtcatgaaactagtgtattagattaggtacctaggtaggtagtaggtaagtcgatacgagacccgacaaatcaaaatcgttttggcgtcagtcagtccctcgtatgatcgatccgaccgagcacacaactaactgtacttcacaacatgcatatacgtagttagagtatatattgtaatcataagagctactggtatgggcacacatttgcaagattggatatatttatggtactcggcagatactaacaaaacaatctacactgtctgttattatttatttatttatttactcccggattattattattaaccgacatcaatgccaccacctgcgcccaaagaacagtcgactcttatcgtcggcgcgggcactttcggcctctcgacggccctccatctcgcaggcgctgggtacacgaatgtcactgtgctggatcgcgccgattccagcccctccccttactctgccgggaacgatctgaataagattatgcgcaccgagtatgaggatgagtggtacgcgaacattgcacgggtgagtgggcgtttgtcatcttgccatgccatgttctgctgccagttcttgcttatcctcacaggaagctatggacgcctggtctactcccttctgggccccttactaccgcgagaccggctacgcagtcgtcgtcagtccagaagcccccgcaaaggcgaaaacgactctgcagaaagccctcgcctcgatacaacacaccaatgcagatgccattcttcccgttacttcccctgcagatctgaggaaacacgtccaagcgatcccggtccggtgacaggctggcaaggatctctaaaccgcaaagctggctatgtccgagccagcaaggcgatgaaggccgcatacgacgagtgcgtccgactcggggtcagattcatcctcggcgaggacggacacgcaaccgagctggagtttgaaccctccacgcaacgattcgtcggcgtcaagacggcacgctcgacgcatcgcgctgataccacaatcttgtgcttgggcgcccatacagtctccttgcttccaagcgcggctgctcagctaactgcgaaagcctgggccgttggacacattcagctctcgccggccgaggcccgtgaattggcaaacatccccgtcatcaactgccgagatattgggttttttattcgagcccgacgccgacaccggactgcttaaaatcgtggcaaatggcgctggttacgttaatctcaagagcgcagacagcacagtctctcttccgacggagtcgaacgatggcattccggccgctgacgaacttctcatccgccgtcttctcaacgagacttttccccacctggcgcaacggccgctggtgaagccgttcatctgctggtgtgccgacactgcggattccgattatatcatagattatgtcccaaacacgggcggaaaggacaggaaagcgggtttgatagtagcgtccggagacagtgggcacgcgttcaagatgctgcccatcgcggggaaatgggtgatgaaagtcctcgaggagggtgagcagagaatagagcggtggaaatggaaagagactgcgacgtcaggctgggacaaagatatctcttggcgtgtgggtgacgtgcagaatattgctactctcggcaggatgacttccaacatgtaggatacgtgtcaagaactggatcctttaattagaaaaatcgtgtgccttccaggagattctcgagaacgccagacaggacaccgcgagacttgcgctcgattaagaatttaccttttgatcatgccaaagcatgtagacatctgcaaatcctcgttgaggatatgcagaacgttatgccaaactgatatatgcgacgtcatcatcaccccaggccttgccacgatggccgagatcatgggcccgaaaagcctgttcaaccgcgattctggcacgccgtacacttcccagattgcgtgtttgctggatcatctccaacttgtccagcacaaagcgtcggtgctcttcgtcgtccagcccggcattccccacgatgaagagtggccacagaagagtcgccgaaaccggaacggtagagatcaagtgtataatcgacgagaccagatgccgcttatatggggttctcaaattggtagccactgctacagcgtcgtctatgccagaattgtccggggaaagagggcttccgatccgttctcgaagatacagcaacgcggtaagacgtttgatctccgcaatccgaatgagatcttttctgtttgccgaatgggatggcagagtctgtctcaagttgcgcaaggacaactcaattccatcgtaagcagccgtaaaatacgacatttccgcagatgtgagaggacgccgtttcaaaatctggatcaggattgcaaatcagttctgtgtcatcacgtatctggtcatgttaccctactttcgctctttccgatgctagggcagatattctgctgatcagagtcatgagctcgcgtgagcaacccatgatcgtatctatctgatggacaacactgtcagtatcgtcaactttggaacgcaatgtgagagccgcaaacctcttccaagttgtcggtcctcagccaactgcgcaccggctcgtcgtcccccgaatcctccgacgccgttcgactcatgatgtcatgagcgacgaaatataacgattcactctcaacggtatcggatgggatcaagtcaatcagtcgtagtccgctgcgaagatgtgagatccacgaagcactgcagtcgtaagaaatctgtcaggatcatattatcagtggagaaccacacaagccgggcaagtacaatacatacatcgtagaagcaaagcatcagcaccgtagcaattgtcccatggtcaaagttgccttcccgcaatgagacgttgcaacccctgcagcgctctgtccttgaagaggaccgcttccttctcgaacctcatatctcccagaagccgaagttggttggccgccaccgcgagcaaggcatctttcagcgtcgggtaaaggaagcacatggggataagaaatcgtaggtatgggttatgcgacgaactcagcgagcagctaggaccgatcctctcgacaaagtagctgagcagattgctctcaatgtcggggttggaagaacgcaataatgagcgaccgatggacgtcgaaagacactggtttattattgcctggtcggtcaaactctccgccagacgacgcaggaccagaggattcctctgctcaacgcgcctatcttctgaaaagtcgctgtacatggtattcaggaaaaaccacctgcctctatattggtccaacggcagccctggaaagacctggggcaacttccgtttcttcttgcatggtctcgacccggtgcctgataatgagcgttattgaggggattcattactaatacgaagtacgttatgtacagtacgtaccttcacggccgaaatggattcctcgctgcaccgcatcctctcggaacaggagtttcagcccacgcacacattccagacccagtctcacacagcgccggcatcgtggcctctcctcggtacactgcacatttttctctggagaacagtccatccacgtgagcaaagcaacctccctcacagcgactctatcaactgtttctctcacctttgcactggacgcagccggtccttctgcgagtctctggctgcttcctcatctgaactgcgcatttgattggattctaccgattgccagagacagggacaaaggtgccgacgcggggttctgcgaagctcaaacgttaaatacggagtattaagacccgataagctgcagaaagccacgcgactgataagctagaccaatcatcatctagtaccccgcaaaactggcaaggtagtcaatccccaagctacgaagtaatttctcatgataaagcatgtctttattaaccacttaaaagaaagaagaagagaaaagaaagaaaataaaaacaaaagaaatacagtctttatttttatttaataacagctaagttgaccgcgttgctaggatgcatcagccatcatccccttggacatatgtaacgtattgtattgtactgtactgtactttattgtaatacacccctctacccagacgaacttcgaatttgggaagggggaattccgaattaccaatcttcaaaaagaaagagaaaacgaaaaagaaaaataggtagaatattagcgcctagtcgattagtcagtcaattgtgctcagtctctgcaatttattatcattgtatcagtactgctgcaccaaagttcctagaagagcgtgccatgaggttgctataagcatgtaattattagatattagatacatctgtgcacagtacatacatacttagcacctactggggcatgatgattggactcaaatggtcttacctgcatgtacgcatgcatgtattggacagacagtacatggatcaagggtctagccaatatctgatagaagggatctaccttacaattaacagggcgattgaagcatttccgagtctgcatggctatgctgcatgcacgggactgtacgtacagtacggaataaaatatatcctgttcgtaagatagggaggatatctgtattgtcgacatgcactgtagtcgaaaagatagacagacaccttggtacagtacatacatagacagatgagatccagctccatcgttcgtttcactcgatacaaactcaacaagggtatcatcctttttattatgcattatgtactccgttataggtactgtacgtatatacttattccttccctcgcgacggtatccacgcttgtggaggtcgatcgtccgctgcctcatactcgataatgacatggtctgtccgcgcgatccggtccagcgggatgtcgtcctcccttctgcccagaatgctcttctggctctcgagatcatcccccgcgatgccgttttcgatctggaccgtcgccatcgatgcccactggttgctgccacggctccggtggccccggctccctggctgactgccactcttgcccttcaccaggctcgagctttgcacatatgcagaactttgccgggctgaccgagtgctgaaaatcttcctccccaagatcagctcgatcagcggcgtcatcgtcggcacgcaggcggcgatgatgatggtgttggcttcgatactggatcaagtcagtaaaccttgcagaatatatataccgacatcggtcatcacacttacttcgtccatagaaatacgtccaccgtgctgtctgtgtgcatcgtcagtccagtctcagccattcgaagtttaaatgatcgcacatacaggtgaaatcgttcctatcagccagccccgtcagacgggtcgacttgtagatagacactgcgcaggcgctgtgctggtcagtggaaatgcccacactcgcccagtcgagatgcttacaagacgcccaggcccaacgtaaacgtcaggccaatcttcttcctgagactcatattcagcctccatactaccgtcgccggatacacagcgagaaacagatcgacaaatgccgatagcgctagtcacgtcaatcttccgaaccccatgctgtttccatcggctgcacataccaccactagcgaaagaataatcttctagcactgccgggctccaacacgtcgccccggtgagcgtgggcgtccacagcgccctcgtgggtcggcactgagcgaacatgatgatcacacaaccaaaaatgaagatagtgctgccccccacaaatatccatagaaatgctttcattcgaggccccggattcatgactcgcgtcaagagagccaccacaccaagcttgggcaccgtaaacgacagaagcgcgggcggaaaggacgccgcgctgaacagcagcgctcgcgagagctgctcggtcgtcaggtcggaggcatgctcgccagttcctgcagccgcagaggcagtgacaaggcttgtgaagacaataccaatgacctgggcacactgttagctcgaatcgcaactacatatcaaaatcttggggcggacgtctggagaattaccagtgaaaatgccatgatataatcatccagcccgatcgtgttcagcaactgcagcctcgtaaacagtcgggcgcccacaaaggctgtgctgagggctataaaggtccacataacggccactggggcctgcgctcggccgttcatgtctcctgcagacgacctctctgtgtgaattgatcaaggcatgagtggatgggcgagaagaaagcatgcccaaaccataaggctgaggcaggctgcaagggtaataacgacagtcttccagcatgcagataatctttctatctgtgctggcggtctcgccattttgcttgtggctcgagtcgtgcccagcatcggggtccaaaatatgctaacaacaaggttcgccgtagagcctataatccgcccccaagataaatcttggtctgttcacacgaaccacagatgacgagtgggagacggttggtgcggcagcctagtatactctgcacactctattattccgttgacagcaaggttagggctcagcaaggatccacagcccaccgggaccctgatgcaactggctatcttagcagcattgagccgtgtacagtgggggcggcccaggtcgaccgcacggtgtactccagactctgtacctaaggttatatatcctgcagccaggccggatgtggctgacccggcggtataccgaggatgctattcgtcacttcttcaagagaaacagcgtccgactcgagatgcgattgtcctccgcaggatggagggatacccaggatagtccgtgctggatgaccgggactgacgtgatcatgataatagctgccctgcacaatgtcagtcattatagcagcactcggcaagctcatcgaacagctcaccgttagtcatcagaattggcatcacggctaatggcgcgcgtgttgttgttagtgcaggttagtgtgtggccaaggcggtcggctggagaaaggcgtccgagtgtccgcaggtgatgatggcacgtgccggcccgtgccaacgtctgtgcagagacggacaatgcgagctctgtccgccatcacctcccacgagtttctgccccgactggcggtgaataagctctatacagggcctgatcgagcgggaaggattgtgaagtgccgttcaaaggttacatgtaccgtctttgtggcggaacaaagcttgtccgttccaaggtttactccacagcagtcagcgagctcagtcaggaccccaacctggacctcgctaggctcgcttatgtgccagatgttggagcagctgacatgcagcgtgcatagatagcattagctgagggatccaacgtctgtgtctgcatcgcctgatgataataataatagattcctgtcggcacaggttgcattgttgttttcgaggtgcaacggagcagaatcagactaaatttggccccatgcaggccagcgatccagactgttgggcgagtgccgaaacgaggagatcggagggctcgaacaagctcatcggcctgaggatctgatcagcgtgctgcgtgtcacacagattgcccgatccctacggaccctacctggccagatggcagcgatcggcaacaatcttgcccttggaagtgaagaaagctggctgggcgcacggctgggacacccgctggtcgcccggttgcatctggagccgtgaatcatatccccaaaaagcaagcgtgcggtccatccccagccttcgaggtgggagctcgagctagcgcgcttcgcttcgccctgcgaagacatcgtggtggagcgttcggctttggtccaatcacgccggatgcaattcaatccggcctgtctgacggtgtttcagaatgccgcgtgtattatgcatgcactgaatcctgacgctgtcagacggagtctctacggagtacttagtaccagaaacgttgcaaagctgcctttcccagctatccgagatgatctagcaattcatctcatattctccgggtggctgacctgttgcaaccgaattgcgtatctcttcctagctgactgtcaccggcttggcgattcgttaccctataaggtgctgacggctgtacgagtggcaggataataatagtgtccactaagattgtacttagtatacttcatatcgatcacgcaatttgggattgacaggggtcaaaggggggttttgtttcaagatttcttgcaaagaattccaattggtacaccgatcccctgtctggtccggaacgacgataaaagtcatggttgtaggacataaacaactccagaataatcaacaacgattcaataattatacctgtctaacagcagacagcctggacataacgctctatcctaccaatacagtctggaccgagaattcccttccattacggtacggtatacaaaatctgatataatcagcgctccatccccataaaccgaataaaaccaaacatgatagacaagccacggaaaaaggagaagcgagcacagctcctactgcgcaccctgcttgatcagcccccacactgattcttccgacgcgttcgaatatgccggtgatgatgcaggaacgttatcatctccacgtgcttcgcggagtgccgcttggtactgttgacgcttgtgtcagcgcgtcctagaatgcaagaatggccgttgacatctcaccttgaagccaaagttcagaacgagcgccgccgccagccccacgcacaccacgatcggtccgaacagattgtcgagatccttcccgctccgctgccggatcagtcgcgaccgagtctcgtacatgtaccaaccccacactgacgcgaacactgcgaatcctgtatagacaatggccagcgactgggagatattgttctcaacccctgccgcattgtaaagggccaacgacagagacgcgagcaagatgctgacatgctgccacttgataaacgtgcgctggttggccagccacaccttggattccacccgcaccggccctgcgtctttgatccacacgctgggaggcttcaccccgggcggcagttcgacccgctgtcggtgagcgcgagcatagcgggacatcgaaaacgacgggatcaatccgccgaaacgagaccccccagacgtgctggcggctgcctcggcctcaggagcgtgttcccgagactctcgttcagcgtgagctggatgctccctcgcggccggtgccactgtcgagggaccggctgccgctgacagtgctggagaaccgccgcttcgcagcggcaaaatcggtgatcccaccatggtttgtcgagggctcggccgagatcctcctaagaagctgccaaccatcatctgctcctccgcctgcttcgccaaccgctcctgctcttcttgaaaagcggtttcggggtcgcggcggatgtcattctccagttcacccaaccagaacgggaacgtgttgatgttgtcctcaaagagctgggcaacaccgtgcacaaacttcgaaaatctcggcgcttctttcacaagatgggacaccatgaggtctctcaaccactccacattgcgtgctccatgtcttaacttgatctccagcagagcatgggggaaacgaacgatttctcccttgttgatggaactgaatggatattccatgccaacgtcgtctatatcccggcgatgccagtcagagggatcgcggcatggccgttccacgtccagcgcatcctctcgaattagggcgaggttggtgtcgagcgaaattcggattcggtcatccccagggatttggaacgccgttcggctgtagttggcccggagtatcggctgcagatcgtattctttgataaaagattgcagctcttccacatttttcttcagggacttggcctgctccgactccccttgcgcctggtcctccagtcggtggacctgcttctcaaacttgtactcccctttcaaaaactcctggacatgcttctccttcaattgcacccggacttcccgactgtggtcatcgtccgtgacgactttcttctccaggaagatggccggcttgtctttcaactggccagtccagcggagtctcaatgatcccgcttcaggggcccgagcgaccttctggttatacaggtcaaattgagggttgtcaaagtacactgacgtgatggtaggatcgggctgggatacatccagttctttggaacctgtcgggttgtagagcaggaccggaagccgccgtagaatgtaggtcttgacctccaagacattatccgcatgcacccaaaacttgtatgacacatatgattcatgaccgacgcgaggctcaccactgaccccttccttgacgtctgccggacccgggctaaggatctggcgtgtaaacgtatacatggccgacaatcggttcaaaagaggagagtagtcttccgagttgaagggcagctgagacagccgcacttgaagcaggggccggacccgataccgcgcaccacgtttgcgatcatgcttcttagcggccttgaggaaaccagtgaagttgatccggctatacttttcgagctcgctgacctccttggtgatattgtctagctcctggagcacttcactggcaatggttcgtcgttcttcctcgtcgaccacttccggttgctcgctaccttccttcgggaccaacggggccaatttggcctcgcaggcagaggtacgctcccgcagttggcgtgaagtgtcgacctgaaaggcattgaccttatccagctgaacattgatcagctcctgcacgaacgcctcctcgtcctgctctgtccagggctggctttcactgtcgctgggatcttcaccggtgacatctggttcccgcaagagacgcttgagcttctggtagtcaatgtatttcccctcccacggagggtatatcgatttcttcagcgtcttgccgaaacgcatcgtggatcaacagagagagcagctctctgagggactgctcagtgagagaaggcggcgcctgtaagatacacgaatgcaatggatcgcgcggatcagcgcagctcccgagacagccactgcgcgcctggctctcctctgctgccagcaaaatagatgatgccaggatccaaatggagatggagagagatctgaggaaagatcgagcagtgtaacgtgcccgcatccagcaagcatcaccagagagagtctgacccacgtgcccgccgccactggaatctgcggcgcaagctccagctcgtcgccagtgctgattggccaatggcatccaagggatcgcatctccgtctgtctgcgctaaaccggatcgggcgtttcatcattctcggcctggaaaagcaattgtccggcagcttaccccagaccaaccaaaacgggttagtgctgcgttacataatccacgcgaggctgaaggacggactgctccgccgtgcctcggagctgacttgcttcagcagcttacgatattgattgccgcggttgacatttttattcgcctggattaatgactgtatagacagatagaggcatggtggagtctcattgatacttatttttttttcgctaatgttcattttcattgcccatccattggcccttctttctgtttgttagtacatctttcttgggaaagtctactgctttcttttttttataaccatgacatcaaccagctcccatgcatcaggagaagtctctttaatcaatgcgcttcacgaggtgcttgtgaatttgcaccagaacccatatccacatgtgtctaacccgccgcaatgcaagaagcgggctgcggtagctctcatacttcgagtgcgcccggaatacggccattggccggaatctcccctgcctcagttagacaagtctgtctctatcattcagcagctggagaactttttcgcccaggaatgggtacaacacggtaatccagaagtgttgttcatcaaacgagcgtcgagggccggggatcgctggaccgggcatgtggcgcttccaggaggcaagagagatccagaggatgcagatgaccaagctacggcaatcagagagactttggaggaaattgggctcgacttgacagctgaagagtacatgccagtgggcaacctccctgaacgggtggtcacaacctcctggggcagtgtaccgtacgtgggcaccggctgcttcttctctgaatggtcctgaactaacgttggcaaacaggcttatggtgctatgtccttacatttatctgctcacgtcgagccgttcgcctgcgttgaagctgcagcccaccgaggtggcatctactcactgggtctctctccgggccctgctgtccccgtcgctgcgaaccgtagaatacgtggatctttcggagcgttatgccagccggggtggctttttcactcgcctcgctacacgctggatgaccggcatgatggagttctctgctgtgcgattggtacccaccgagagcctgtattgcagttcgatcccgggatttgtccccgagagcaccagctccgagtcattgtcactcttccagaggtggaaagcatggtccctaagtaaccaagccggttcgagcgacccaagtcgcccactgctgttatggggactgactctaggtatcatggccgacttcctcgatatgctgcctccgcataacgcagtccagctgtggaggtatcctactttcacgtgtcccgatctccggttgattgttaccatcttaacatacccgttacggaaacgcaatgctctcaaggtccggtctttcagacgtcccagtcagacggcagccgatgcttcgacagtagcattagccgtcaccgaagagaccgactccaagtataatccgaacgaggtcggcatcgggggacttggggttggtcggtactatggaccgtcaccgcctgatcaccagaaagcaaccaatcatgccgtagggattatgttgaatggctactatgatcgtctccgggtggcgatgtacgtcttcctggcttggagactggccgcaggttccattgcgtcgctgtacgtgtggaagtggcttcggcggcgataacggccctctattcgtttctctaggctcttagaatgtatatgtagttagaaattcgaggttgcaggccatagaagtactcgatgagctgatgccggggtgggcagttgtgctgcacagcgggtggttcgccctggcgctaattggcatcccgtcaatcgtgagctactaagaataccccacccgactaattgcttgtaaacacaaaacatccagccatcgacgctgccaggaaccgccaactcgacaccgtcaatcgtctctggccagtcataccatcgccgctactttataccgcgactgcgctgtgagacgaagatggttgtcgcgcaaaagctgtatcctcgcgcgacagtgaaacgcatcgtcaaagcccactcaggacgaaatgtcagcaaaaacgcagacgttctggtaagagcccaattgaatggcctccttgtttatgctgtgctgtttaccgcctgaccggtcttcctcttcagttgctgacctgattcctgtctgccacagatctttctcgactatatgctgttcatgcaggagtgagcacctccccgtcctccttgaaccgtctcgaaatgattcccatggccattggcatattgacgaacgcgtccttgtaggctcatgcgcgaggcttcgatccgctcgaggaagtctggggagaagggcatatctgcaaggagcatacgcaaggtgaccgaggtgcgtgtggactagcagtgtcacagctgcagcatgcgtctcctagattcattcgaatattgttactcacacagctctagactacactgcgaaagatgaagggataactttttcactctacatgggtcatagcggttggcgatgttggtatattgggagttaatgagggaatggcgttaaagaggcggttgtctttctgctatcatcagagggcttgtgtgaattttagtgatacccaggacctatagctagctagctgatggaattgtaattatacaaattacagcagtaatcagacttcactcttggcggtgatattcacaacaatcaatctgctgatctgccaagtccaattctaaaaatggatgagctgaagaggcgggtctccaatgaagcgttgagaggcattattttggccttttttcttcttcttttttagccaccagttctttgtccggttgtccagcgcaaccagcctgaaggagtaggacaagcacgcgaccgaggcggagctccaagcggctctcctgtccccgtcaaacccttgaccgtcttaactttctccagccgtccatcgacttccagtcttcacaccttggacagagctgcacgcaattcacttattcccccatttttccttgctgtattcttctaatcctgcacgcccatactgctttgcactggttacctgctacatatctctcccctgcaccagctgcacgctcgcacacacatctgccctcctaactctcacacgcacaaatcatcaccgccatcatgtctgcctcgcctgccaccaacaactccaccgcacaaacagagtccaagtctgcgaaaaagaagcaagcaacgagcgaagcttctcagagtgtagatggcacgaccccgacaccctcgaacccggacactgagtcaaaacctgctaccaacggtgtggccgacgacgactttgatgaagccaccttcttcagggatctccagaagtaagaaccctctgtttttttttttttatgaattgcattcgtaacgatgccattgtcgcaattttacgatcaaattgctaatctgggtctttacaggagcttgcgcaatgccaccaagaaactggtgtgtaacgaccgtccagccttccctcctgatcagtatcgactgactgccttagaacgccactgccaaagttgatagcatcatcgccgaaaaccctggaaaatctctcgatgacttggttgccgagaagaagatcaatgtagatcagaaggctcaagcattgaagaaacccacgctgcaggccaacgtcgcccagcttgaggagcaactcgctcagtacaagaaatttgcggctcactacgagaaacgtcttgccaaacagaaggctgatctggagaatgcacacaaggaggagcttgaggccgtgcgggaaaaagttgcagccgagttgaaagagtctcatcagaagaacatccgtgaacaattgctcgccctgagcaaattcctgcgtgctgctgctgccatgagacgcattggcgatgagactgcgccggagagccgagcgtttgagggcgtgctgttccaggtctacggaggcacttacgaggccgtcgactcgatgctcaagctgatcaacggtgctgaggagaaggtccctgcggtggagggcgacatcttggacgttacttgtgagtattttctttcaaaaaaaaaattttttttccgacattgctgactttacttttcagacgcgcaagtgaagcagacttcggagcagtacgctccagctccgcccgagggaacctggacacagagtcaggaagcccctgctgcggaatctgcgccagcgtctgatcctaccgtggccaatgctggcttgaccgaacttcaggatacttctacgacggcccagacgaatggagtcgccccgtccggtacaactcaaccggaagttactacggctccttcccaaacgtctgtcggggatgcagcgaatgctgcggctgagacaaactctggaaccgcgtctgcgaatgctgatgagtggactgaggtgccgcgcgacccggccgagaccgagactggcgtccaggctacccctgcggcgggccaacccacgaccacctgggcagaggatggttctagcacccaagcgactgccgcgaataacgaaggaaacgatggctttgagcaggttgttcaccaccagcgacaaaacagcatccgtggtcggggaggcgctcgcggacgaggtcgcggtgacagcttccgcggtcgtggtcgaggagatttccggggacgaggccgtggccgcggtgatttccgaggcggacgaggtcgtggtgggtttgcaggccagcaggccaaccgcgcagaggccgttgccagccagggatgatctggtttggcaaaaagaagtctttgttgagatctcctgaacttttatcatgttcagctgactcaatgtagactttgggctgcgcagctcacattccggtcggttctcttggtcctggtgcttcctgctttgcattgcgccccgcctctcttcgacagctcgcgttcttctaccgggttttccgctctgcatttgttatttcttttcttttttctcctttggatcggtcggcgttggtacggtccatgagtggaacgaattccgtcgtcgggtttggttgttgagggatgttctgtgctgcttatcgcatgggttttcttccctacggctccggaaaagttcatgttactattatctcgtgtggtcattgagcgttgcatttttttttaccttatggtgctacgattcccccaatttccttttattttttttattaacgatatcctcgtgggaagggcgtcatgtttgtttagctcttctccatgtccatcatcagaatcatgtactttacgctactttatccttgacgagcctttggtcggatgggatcaggtcctgggaatctggcgcaggcggataaacgggtgggctggttgccgggaacaagtgagtgtatgaagagtgagcatggtgccgcatgtctagtggtagttatggagcaatggaacgatcgggtgtgaagcaatcaaatttatccattgtacagtacagacagtaatttgtgtagagttggtcactgatcgataagaggagatctgggtgggttcattccattctgttctatcattttgaattccgaaaagttctaaaagtagaattctccatccatggatttccatggataacagcgtcatctatggagtacgccgtacgtagatctctttttaacaaggggggttggccatggatcatgcattggcggcattaagtgcattacgtatgctccactttgtcggagtatcggagttattgctatgtcacagcctctctcacttctgaaacaaaatctcatgcagcggcggctctttctctctctgcaggtgcagtattttaacgggagaaagtgtcaattgatttgagcgttcctttctgatattgacacattgatttaattatttgtttatttgtttgcttgttttgttacttacctacctacctacactactgtggttcctgtctatgatacgagttaacgagaactgtctactaagggagtagacgaacaacggtgaatcgtgtcttgatcgcataacccggcagcacagctgggtactgtaacacaccagccatggcgtcgacatcgtcaacagccctgtcgagcaaccagaaccagcggaagaaggtgttgagggtgattttcatctctcttctcttggacttggtatgtaaataaatctatctaggacttcttctcagctaatgtgtttttccgtctagatctccttcaccttcatcctccccctcttcccctccctgctcaacttctaccgacagcgcgacccctcgccaacctccctcctgaaccgcatcttccactacctcaacacctacaagaacgccttcgccaagccgatcgattcccgctatgatatcgtcctgctgggcggcgcgctgggctcgctcttctcgttgctgcaggccatcgccgcgccggtcatcggccgtctctctgaccagcacggtcgccgcacggcgctgctgtggtccatggccggcaacatcctcagcgtggcgctgtgggtggccgcgacggatttccgcactttcctcgccagtcgcatcgtcggcggcctgagcgagggcaacgtccagcttgccaatgcgatcgcgacggatatcagcgatgagagccagcgcggctcgactatggccatggtgggcgcctgcttcagcatcgccttcacctgtggcccggcgctgggggccgcgctggcgaacatcaccaccatcgctgcgaacccgttcgcgaccgccgcgggcttctcgctgtttttgatcgtcctggagacgctgtatctgtatctgtatctgcccgagacgcatccaaagcttgtccggcgggaagacaaggcttcgaaagaggaacctgccacttcgaacgatgcacccgaaagcaaaaaccaacgccaaagcacgaccaaacaaacgacctccggcaagaaagaccgacagtatacaaaccaccccgccctgctgaacctggtgcatctgctcttcctcctccccttctcaggcatggagttctccctccccttcctgaccgcgactctggtcgacgagaccaacaagacgataaacccgtccgccctgaacgggcgcatcctctcggtcatgggcctgatcgcctcgctcctccaaggcacagtcgtgcgccgcctccctccgctactgacgatccgcatcggcgtcctctcctgcacgatggcattcttcctcctgggaagaatcacctccctgtccggcctctacgccgcagcatgtttcctggccgtcaccagcgccaccgtcgtcacgggcctcaacagcctgggcagtttcgaggccgacgaaagcgagcgcggcgtcgtcctcggccgtctgcgcagctggggccaggtcggccgcgcggcgggacccgtcgtcttctgctcgtttttctggtgggtggggagagaggtcgcgtatacggctggcggggtggtgatgttgggcgtgtgcgcgattgtgtttggggggttgaggactcctgtcaggaggaagactgactagatcagttagtcagtcagtcagttaattactcaccttggttttggtttggtttcaatcagattaaattaattgaatgtctgatagatatatttgtgtacagtactgtttaagaagtaaatagatttgaggcctgtgtattatgtatgtatatactgtacaatacaatacgttagattgctatcgccgtcttataattattgttatttattattcatacctactctagtgattgactgatcagaatatcctcctagaataatcgaaatgaaagatgcaatcaacagtaacaacgacgacgacgacgacgattgattcattcccaataactacctccctacctccctacctaactagctacctagctagctagctagctaattcaagtacactgagacactgtctgcctgggtatgtatacagagtggggatttccaacagaaaacaagaaaagaaagcaagcaagaaagaaaaggacatggaatatggaataatacatgctatcttgataatagtactagtggtagtagtagtaatagtagtacaaaaatgcagtgcaatgtatggggggggaaaaacgaaatgaaaagaaatgaaatgccccccttttttgtgtgtttgtgcccaggaaatataaaaagaaattcaaaactgggtcataatacaagctcacgtctctttcatagcgtttgcccatcaagattgccaacgtagagaattggtcgagtttgacgacaggtcaattgtatgtatgtatgtctacttgttcggccgtatccgtcgattcgaatcgaggttgtattcctcgcatccctgcgtggccaacgacggcccagctgaagggtccatcgaccccctggccttccccaagagccagtcggtcagggtgacgaacttggccgtgcgatcccacccgtccgcctggtcagcgtgctcgatcgtgtggctggagatgcggccctcctcgtcaaacccgaagatgaacagccccgtgaactggccctccttgcccagtttgaagatcggtgcttcgccgcccagcagcgcgctcagccctttgttcgtgcctgctttcgagtcggcgagatggctggaaccggccgatgagggtgatgccgtcgaggtcgaagtcgaaccaccacccccttcatcccgtgcctctgttctccatcgcacgaccagtctttcctccccacagctttcgttgcgatcgcagcccagcacggtgtttgcacggaccatccgctcgctcaggatctgcaatttcacgtttccaaccaggggaacactgctccaggcgacgggcactgtccacagcgctgctcggtagagcactctgcccttgacattcggcagatgcggatgtgtcgacgggaagagatggagggtgacctgcggagacagaatctccaaaggcaacgggttgatcaggatggtcggaagaagtggggagagggtgcgaagggctaaaataaacaattagcatgaaccatgcaattatagaaacaaatgcaaacagctcgtttagatctttttttttttacttcactcttcccaagcttcagaacccgttcatccggcggcttgtgatcgccgctggcacctccgttcaacccatcgggcacagggccgccttggcctcttgtagacgagaacagactcgcgggagacggagcaaaccagagctcatcctcgagggaattgtaatacggctgcgcaaggaatgcgcacgacgtcgagctaaagggttgctgttgttgatgagagcgcagcagtcggagtcgcggagaagacggccgcggggaaggacgtagccgagcaacagcccatcggatggaagaagcaatggcggtagaggcaggaggacgacggcaagggaacggcttgggcatcacgaaggccgatgtacgagctcgtccggcgcagaaacgggctgcagaggccgtggctgctggagatacattggcaagagggtgggagggatggaaatggcgagatggagctggcagcagccattccgatgacgttgttgggttggccgggccgagccacaggaagaaatcaattctccagacagaaatcaacagcagaccacagggccaacgccagaaaaatgaattaattatgtcatgctgtctgcaatctaatagttactaatttaattggctgatctgctgatctgaaatgtcggggccaatgatagttgcctcattaatcagacagctagagcatatgcacagtacggagctcgtatttagtaacatcaagcgtttcccttatctccaagtatacaaaacaaccgtacacgaaataaaatcataaaatcataaacagaataaaattgcttccgaccaatgctcctggcatcccaattctacccatttcgttgatttcatcccattatcaaaatgggggaaaaaaatccaatcaccctagtactatttcaagcaagttcgtcgtcctcatccatacccatgagccgtcgttcgccaagctcgcgaatcttgtcctccagcacagaccgcccataccgctgagcgaccttgatggctgcctccagcatcttgccgctgcggtcacgcatcatctccaccagctcaagcgccttcataccccgctcttcgccctcgcgacactcaatcgctagcatctggagcaggatcttgtcaatctcgacctctttcctcgccagctccgctcgctggttgcgggtagcgttcgtgctggagatgagatcctggtagaggctgaggaagaggttctcgcgcacgaatgcctcctcgaaccgggctgcgtcgttgcgcaaagtcgtttcctcctcgtcctcgttctccttgggcggtgccgtggagactggaatcttgaattcaaactcagtgaggagaggcctggggaaatacggatgtttctctcctcccttgaggataatgcagtggaatcggttctgagcaacagcaacaggccagtacgtctcctccttccggcctttggccagtcggtccagaagcttggtgtccagcagcggcacccaacgagcctggccgggagttcgccagtgctggagaaccagaagaacaccgtccgaatcgtatatgcacggatcctgcacgatatcagcatagaacacccgcgattttctcctagtgaactcacccctgtgtcagaaaagaagacgttctgcaactccgagccctcagatagggcgacaatgtcttcgttctggcatacttcatctcgcttgacgttttcaatagagtatgtcagcgtcgaacacccagaactgcccaccggcccgtttccaacggtcaagacgtagtctcgccaggccgcacacgtcacggcagagctcttttgtctgtagatccggaatggcgtgccatagagtgtatatatgcggacgtaattcttgctagtcaatacaacaatgtaggaatcgctcaatgcaattgcttattgcagtcagcatgtgcgtcacccaattcatcggatgtctactgactttcaatcgactcttgcggaggaagctgagtccgccaatccgcccgtgttgtccaggtttcatggggacgataatagatcatcgccggagtatcatcggttgggggcgcagcgaacacggtgccattctcatctgaatgtggtcagtatattgcgcgcggtgattctcaaaggtcccacttacttagacaagctttatcataacgatatggatcagtgaagtggaagtttcggtgcagctctgtgtcgtagaattcaaccgtcacagtattgtgcgattcctgatcaactgtccaaacgactccagtcaaattcaagcctaccagcgtcagtcaccttgtccacaagtcaaattcaggagtcgaatcttacagagatagcgcctgttgcccctccacggggtacttccaggctggaaaggagcgtgttgcttaggctgccaaaacgaggcaagccgcttgctatcatggcccgggagatcatccagatgaccattcgtacgttttccgtacgcattgacattctccgcgtagccagcgccatcatcgtcttccacaaagtcgtcatcttcatccatggggccgaggatatcatccaacgaatccggagtggcatctcgtcttggcctgttctccgctccaggcttcagtcgattaaccgtcggccgtctggcatttccagacgtctccgccaatggaccggaaagaagaggagcggcatcgagtaccttgtccagcagcgacctgtactctcgagggacgaaatcttcgtgtatgaaaagctcgccatcggatgtagtaaacgacagtaaattgctagagggatgccacgcaagattgatcacgttcgcgaagtcataccgccgcaggatgttctgcgtgctcgtctcccaaagcagaatctggccatctgcacctgcagtcgcaagcagcgcaccattgggcgaccagctgagggcggtaatttctccgttatggccgcctgagaacgacttctgtcgactccagtcggaggcagagaagacgacgacgtcccgtgtggcctgcgccgatgcgaaagcagtgccatcgggatgccagaccgctctcgatgtcgcctcgtcttcgggctcaagtcgtcgaatcacgccgtcgagttttcgcaccaactcgggttcttcagagacaacggaatagatgtacagaattccatccgtgcaggagacggcgacataccgcccagtggggtcgaaagtgacatgtttggatcccttggtctgctcacggaggtatttgaccttcgtgatgtcttcgacgttgacaatcttgactgtcagttcacttcatgctgtcagctcccgtacgcgttgcttcgtccacggaaaggaccttactcgctggccaccgcaatccactcgccgtcttttgaaatcgcgacgtctcgcacgggcaaagcgcatcggacgagcagcttgtccatcttgccagactccaactcatactgccaaaccgtgccatcctcggcgcccataacaaacgattcattctgttcccgtcagcccgaacgatcatcgaaaaaaaattaatggagcagtaccgttgcggcaatcccaaagtggccttccacgccctcatcaattgtcgtaggctcgccatcctgcccgactgtatagatacgaatggcggagttcgaaccagcggtaatcacccgtcgaccatcgggagtatacgtcaagacggttgttccgggggtgtctggaaataggaaccttgattagcatgcaagattttcgtccggcgtagcatgatcttccatatctaagatgataggtgatacgtacgggcaggcctccccctgggtcgaactgcttccgatgtcattgttgttgttatcgttgcatgcggaccggaccgaatcaattaattcttttgtcacggatgggcgagcccagaggaaaacaagtgtcttttgaaaagcgactccgtgatgcggaattgaatctgtactgtactgcaatctagtccgttctccgcaatggccgccgacgcgttgagtaatccgacgcgtcgcgcgacacggcatcacactcccgatttaggtatcaaaatagggcttagggcttagggtcaggatatgccgacgaatcaggtctataattgaaacacttccatttcaaatgacagtttgttctatatgtagaaaatgtatctaagtataattccttgttctatctatggcccttcagcggtcagaaagtcgaaatcgacgccgtcctgcgcctgattgaccgatcgctcgtacagaccgcgataacccctcttgtgtttcctcgtctccacctccgcagataatgccttcttcctctccgtaatccgctgctgcatctcttcatccgatatctccagctgcagcttcctgttttctacgtcgcaggtgatgatgtcgcccgtccgcacgataccgaagggcgaatccggcagagcggactccggggagatgtgtagaacgatcgtccctcccgcagtgccagacattcgtccgtcggagagacgcagcatgtccttcacgcccgctgctcccagtttgcgcggaagcgggatcaggccagcctcgggcatgccgggattgccgatgggcccaatgccctttagcaccaggactgagtccttggtcaccggcaagtctggatcgtcgatcctcctggctagatcagcgctgttttcaaacactacggccggaccggaatggcgcaagagggagcggtctttcgatgcagacgctttcatcaccgcgccgtcaggagcgatgtttccgcgaagcacgacgagggacgacgagggatagagaggattagagagaggcctgataacctgctgcgagaagggaaatgtgcggaacggagactcgtcaagaacctcgcccagggtcctgccggttatggtcatggcagacagatggagaagcggtcgaagcgtgtgcagcagcgccagcataccgcccgcattgtggaagtcattcatataattgtcgccgcttggtttcaggtctatcagaagcggcgttttccggccgatctcgtcgaatgtctgtaatgtaatcacccccttgagctgtggatgtctattggcaatcgctagcaggtgaaccacagcattagttgagccgccaatcgcctggagaacagttatcgcattcagaaaggattcttttgagagtatatcctgcggcgtacgctttgccttggcgacagcgacagcattcgcacccgtctcctccgcaattctgagacggctagaggagactgcaggggcggtagcgcctcgaagaggcatcagccccaaggcggcagtgatacaggccatcgtactcgcggtgcccatgacaccacaggttccaatctggagaagtcagaaatggtcgtcaatcacattcaagaattccggaagagtgggaagctcactgtgggcgccagctcttcgttgatggcggagatctcttctatatcaatctctcccgctcgataggccgcccaattgtttctgcagtcggtgcaggcacccagtctctggcctcgatgactcccggacatcatcggaccagtgaccaaaggaagcactggtttattggctgagatgccacccatgagctgggcggggactgtcttgtcgcatcctgcttcctcgtcagaatcatgccctaaaagaagaaaaagtatactcgtgtagaatactctactatagacggatgagaagaagataaataagaaggagaatcaaatacctccgatcataatgcaggcatccattggctgcgcgcggatcatctcctccgtgtccatgctcatcaggttcctcaggaacatactcgtcggatgcgcgaacgactcatgcaacgtgatcgtgggaaagtcaacggcgagaccgccgtgaagctgcacaccgcgtttggcggcttcgatgagctggggcacgttggcatggcaggggttgtagctggagtaggtgttgattatgccgatgatgggccgagagagtgcatcatcagaataccccagggccttgatgaaggctttcctcaggaacagagagaaatgcgcatctccatacgaggtgagtccctgccgcaggccagacgtggatgagatgggtttggacagatcgtagtcgtccttcgggaggtgctcggcctcgtcttgtggcatgctggatggtgatgtcaacctatattatttcttataaaaggtgaagggatacaatcgattatttacttttacagcaataagacagcaggaggcctagagcaaccttttttctaatatgctggacacgagtggccagcggatgcggagttgggccgatacatcgtggtggagtaactccgcgatctcggattcttctccgcagcggaaactgtcaaggagacgatcaagacggctgtggatatgcttacaacacagtgacaaaagtcgacggttggagaaggcataggctggtgataagcccaaaaacattaaggttgcttcgcttaatcctagaactccgcgctggcctgtcctctatgtgatctaagaatatgacatagaaaatatgcatatagatacatatatataacccgaacaaaaaaaagaaagaaaaagaaaaagatgttataaacattacaaaaccatatagccaactagacacgatgcttcatccggactctcacatcgccaaccgggatataggtagcgctcccgggctttaaacccggacgcttccagcccttcgggctcacgggtttgacgtcccacagcgcgagaatggcagcggtgaaggccaatatttcgcgttccgcaaagacacgtcccttgcacatcgatgcaccaccgccgaaaggccgaatcgtgcccatctctgtcgacaccttgcccgtttccggatccttcacgatgaatcgatgggggtcgaatttatcgggattcttatggtaccgaggatccatttgatgtgcgccattgggcacgacaaggatatcgcccttgcggaagtggtacgaccgtggctgcgcggctccaaagatggccgcgtcttcggccgattcggtcagggtgaggtcgctggacagctctcggtaggacgcggagttagtgtacatccggatggcctcatagaacgtcgctcggagcagcgggcacgaggtgagcaacccctccaggttaagagagagacgcggcggctcggcgaacggaaggccagtctctttgggagtaagacgagaagctttgacaaagggtgccatttcctcttccagtgcagcatgcagactagggtctgaataaatgtggagcaggatccagaaaacaatgctcgaactgttcacattcatagcccagagcacggccaggtctcctttggcagcaacgcttggggaatacccagccttcctccaggtccgcatacgctgcttgatcatctcggaaaggtcgtcaagatcacggagcatgacccctggatcgcggccatcctcgacagccgcaaacgccatatgcagcgcggtaacgagcttgtgaagacgatcacgagcaccatacgcggccgacacactcggcataggaagccatttgggggctcctgcaataagcagagagaatgccttatcaaaggtccacatgtcttgcagaagaccggggtagaactcgacgaatgatgtccccatgaaggcggtcgtcgtgatgtatgcgataaagctccttgtcagcgcgaatagattcgcctcggcgacaggaggatcgctaccgtcgaccacggagacgtcgctgccgcgttcccagacattttgatcgacaacgctgtgggcgaaggaaaccaagttggcgatctcctgttggatgagtttgactgcagccgacgaggtatccgtcacataaggctcccgcaagatcaggcccagagcatggttaagagactttatatggctcttgtccatgcgccgagttgcacctccatcaccaaacacgttttccatgatgcgaaacacgaagaaatccgtcgatgcgcctcggtgggcaaatagcgccttggtcatggacggcgagaagatcatgttatgagtctggcgccccatctgaagcgccacgatcggctcgttgatggtttgtctgcggcatggtcagtttcttgtatttgtcgcttttataggagcaggagcagagagaagtaaaacggaccctgccttgagaatgaagtctcggtggcccctggccacagacaccaagtgtcccagcccaggaatccagtaaggaagcttcctgaccggatgcggttcgccctcgatgaccttcttcggccggctttgcagaccgctgatgattcgcgtggcgagacatgagaagaacagcaccgcaatgaacgtctgcagggccagcgtcggggtgatgtcctccacgacctgcaccacccgatggggcaccgtaacgtaggcctccatctttggatcttttctgaaattatctttccagttgcagtctcacaaacgaatatccaaaaaaaaaagacgagctgcgacgaacacaaacggagaggctctctagtgtatcagatccacgtgatggcacagcaagagattcgaaccagtgcaatcggccagcagcccaatccccatcggtgctgtgcagttatacgagagggataagattttttttcatgcccccctcgaagtaggaaagcctctcaacctctgcagaaagaatcaaggagaagctgtggagatgggaggtttgggctgtgtgacatgagacgcgcgctgctgcgccgctttagcgctggtccgatctccgtccattgcgagggatcgaattgaccgaccacttcagagattttgattttctcccgcttgctgtgcattatattttatgttcgaataaagtagtcgatgcatttctttttttttctcattacggaattaaaggcatcctgtgatatcacagaggaccgtctggatgtcttgctgcttttgcgtcacgtgaggctccactgcgggaaccggaagtctggatttggcacggagcttattattcatttccaatgattaatttcttgatcttgtgaggctggaataataaacaaagtccttctgcctccctaggtaattatgaactacttacttatatggtccaagtatttctagctacagcttcacaaacgagaatataatgggagaagctaagctctgcaaggttgcagcatcagccaggacatgctagcagttacgtcatttagttgatcgatcggcgtcccttatttggatgactcgggctatactccgtagagcctccaaaggcgactagatgccagttggtatgatattaggcatgatggaagaatgcgcgataaccctctgatcatgtgttggagctctgcatgcagaccaacaaaagcatagagctaaggcacttcttggcccatctgcaacatgattgacctttggaaaacggactcacatctaggccttctcgtcacttgaccaagccattaacatcccggatatatttgtatatgcagtccttttcaagaaaaagttaaaaaaaaaaagaacgattccgatgcccatcgttttgacagagtagtagaattctttcagcgctcagattgcaaaacccggtccagagatgcgctttccatttcgtaccgctccacttttgcctgtgcatgctcgatcttccgcagcacccattggacccgcgaggtaagctgactcggttgcttgtgaaggcggccaagcaactgaagctcatcttcatacttgctaattttcttattctcgttcccaatcagcagagcgagaacagccaggtcgaggcggctgcgtaacactttatccccggtcagacgtctgaatgcagcgtgatatactggccgggcaggcttaatggcagacggtcggccattaaccgagacgaccgcgaccagctctgcttgttcaagagcctcgatcacggcctctcctctctccttgaagagcccagagagtaagatttggttgtacgggacaactgcatcttccgaatttgccaactctttgatgaggtaccatgcctgttcgcgagtccagtgccgagtgtcgggatcgacttccaggacgaagaatttcaggatttccgcagcagactgttcgatgatccgattcacagcacctggggcatttagtcagcgcgcacataggtgtcattcatggaagaagcagaataacaaactttgagggctctctcctgccttgatccgacgtgccataaattccaagtccggcagacgacctcccaaggtggcgacgcagctttctaagtcttccaatccttgagataaacctggcttggagccgtcatcaccaccattacgctccaggtaactcagaaggaatttcttcccgacttcaagagagcagtcaccgagcgagatggtccgaaacacttgattgggcaacgccttgctgagagacttgggatacgatgggtccgttgtcaaaaagatcacatgtgcaatattctctgttgtcagcgcagcagcccattgcgccagcttgtcgtagaccagagtcttttcgctggcccggtacaggaaattatcgatcaccacgacgggtcgccgctccggatgcgcctctagatactcttcctctgacaattgagaatctcgatcatcctttccccgctcctctagcgcaatctgcttgagggcatttccagtgttggcccagatcttaccaagctgcgcatccagtgtgtccgaaaatccagcttttgtcccgattataccctgggaagccaggtcgataaagctgctgatactattcatccaggagaagacgggtcggtagcccacctgggtcgccgcagcggaaatcattgcagagtctcctctcgcttcttggataggcttgcaatcaataatgaccttgtatctatgccgcttcagcgactgaataaccagctctcgcttttccgagccgtgtgggccttggacgacgataaaagtacctgcgctctccatcaaccaagactgcaattgagcgacatcattcttgcgattgtcccagattgctgcgagtatattgctttggctcttttggtgcccagaggagagaatatttgcccttcttacttgctttcggatccactcccaaaagcccttctcctcggtattcagtaagtatttgatccggagcttgataaatgccgtgcggatcggatcgaagatgatgacagttatccccgcgatcagcgcggctaaggtgggaatgacgattctgggatgattgaacagccactccctgatccaggagcctttgatctttcgctcgtatgtgatcttcagaaccgtgccatgtttaccgcccccatccttttctatgactgtcagaccatgcacgcaactcctggccaagacggcgaatttaacccgactgaactccacgtaggcgaacttgggtgtaaccggcgaccccggttgttgccgttctatatccctcagtttcccatactttcggaaaatggtatataaggcttcttgcgtcagttcggtcgcagtggtttcgggcgacgtcggacaaaactcgaccttcaacttggggctcggaaagcgatgcaggtcctcgatccatggattccccacgacgcgccctaccccgacctggtcaaacggattgaaccacggtcttatcggcttgtccattagatggattttcacggcctcttctatctcctcatcggttttatcaggcggacgggagtacttcacaaacagcccgccttctttcagtcgaggaacaaccgccttgatctcaatgttccaatcaggcggcatggcccgtcttgcgatggcccagtggtctgcagcggcgtaggagggctgattaaactgtctcaaaacacggtcaacaaattgaccctcgctcaccggtgacaggcggaagaaccactggagtcgtagcggggcgatgtctgtagatacgcatcataaccaattaatgggatttgatacgtcgaatggtagaagacgctcactgttgatgaaaagcattccttcattacgctctactttgatgcgcccctcttcgtacggcctgtttgtcgagtatcgcacgcctgcggctgatagaagctgcgtgcgttgcgcatacgggccacaagctataggaggacgtaggagcatgtgacgggtcctcaaacgtgacaatgaacaaacagggtctggtacccatattgggagcgcagcccgcatcatggcgaatgcggcagaggagctgctgctggttgactgttgtgctgcgtttatctaccagcccaatgacgtcgctgggaaggcagttgcccgatcgggacgcagcgtattatcggccacgccaaggcggattcaattctatcaatcttccccgtcacaacctccgacgccgtcctccgcagtcaattcttcttcctcgacaaacgcaccgcaggatcttcgacgcgacaataatgggctggtggtggagctccacaccacgcaaagatgagcagcaaagctccgctcagcccccatctcctgcgcccttggaggaagcagggcaacctccccagccgtccgctgtgccgccaaaaccgtcgaagccgataacgcgcgatgaacaggcggaagcagaattcaaagaatttcttgccggcctcgagggaacggcaaaaccgtcctccaacgcccaacccgccgaagaagcggagacgaaaaagcccaaagaccctcctgcttcgatccatcccgagtcattgtatccagacaccatggactgccgctctgcgttcgactacgcattcttctgccaatcctttggcggccagtttgtcaacatctatcgctacggcgagctgcggtcctgcagtgaacactggaagaatttctggttctgcatgaagtccaaggcctacccggacgagcaacgcaaggagatgatccgggatcattaccggaaaaaggccatcaaatacaaaacgggcccgagcagcgaggatgtgtgggaggtccgaacggagccggtgaagaatgccttccagggagatttcgctgctcttgaaaggcggatgaaagaagaagaagaagaagtggctcgtcggcaacaatgattgactgcagaaagagggatggagaatggctttgtcggataatggaaatatatagacatctctcgttcttctcgttcttgtataactatgggcaccaaggcggagtggacagatacccattctttatgtctggatagaaagttacgcatgcactgtatgtacattacgataggaaagaaacaacccccagtcatgttttgaacgtgttcttattactcgcattttttttaaaaaaaaaaaagatataacgagaattatggcgaagaatattgccaccatgggcaaaagcgttttggttatgtcgatcaggatcccttatgggcaggttggactttgcatcgaggatcactcatcatacagccaggctctggttgcaatatagatggagatagttgtcttttttttttttcaaaccaagacagctgctctttaatatggtccattctgcgaaaagtgctccaggctagtagtattcctaaacaagccatttggctggcatatcgaatctaatagtataagatggagagagcaaccaggataacatggcagctttatccaagattaagagggatagtaggctcataacagtatgtttgactgatcctttccacagtatctatataacacaattcagcatgggtcacagcctggttaagcaaacaacttacattggctaggccaacatcacctttacttgctccctgtctaatgccttctatcgtcttgattaggttctctgctggtcaatagtgatatactctaaagatgaacaaaaggattcatgtagctatgaaaacatggctggcaggcaaatatggatccatatgagtctgacgtccgcctggagagaacataatcaccattcaggacaagcattctgtgggaaggataatctgagtcagtagcccgcctgagatgcagatacctagatagatatatgaccgaatcattccatccgcaataccccaagaatcttctcaataataatactagcattaatgtggaagaaaacgctaaaaaaaaaagcgacggataatcataccctacgtatgtatagcgcatagaatttgaattgaactcagtttgaaattgaagcaaatatatacaaccaaagaaaaaaagagagagaaaaaaaagaggctaacacaaactaccatcacagagaaaacatcatggcaaaacataatcaatcgaacgcggtcagaaacatgaagacaataagaaaaaagaacctgcagaaatcaacgcaaaacatttcgacactaacaaaagaaatttcagtgtgcctccagtccgttttttttttcccgcagtcgatcgctctcattcattcatccagccatgtgtcttctgaaacccatcgaaaaaatctatgaccgccccaaaaacggatagtatagatggagttaacagtatcgacactaacgccatggttccttcaacctgtgcatgacgaagactgaacgaactcggaaaaaaaaaaggaaagagatgcaacgttgcgctccaagtctggggtatattgtatcttttcataaccaaacataaggtattgttgatgtggttgactttgttccgtgactccgtcataaaagattcgccgtaagcccggaggttccatgctctgaaatagacactgccatattcagcttggctgagatagtcaggtcgtgacttcgaagccatcgcaatatttgccaagcttcagctgggtcgtgtcatccttaagcagtggccacttggactggctgagggacggtgtcagcagccggacgacggacaatgcctccagtcacaggaagctgagagctagtgcccatcagataagagtcgacttcacgagccgcttggcgaccctcgttgatgcccctggatcgatctgttagtccgtatatccacatgcaagagcgacgatataacttaccagacgatcagagactgtccacggcggcaatctccggcggcgaagactccaggaacattcgtcgagtattgaccaggaggagtcttgatgttcttccgagcatcgcgttcaatctcatcacccaacagacggtcctcaggtcccaggaaacccatagacagcaggaccaggtcggcggggaagaactgctcgctgccttcaatagtcttcatgtcccagccgccagtggcactctttgtccattcaacacgcacggtgttgatgcccttcacatggccattgccgtcgtcgacgaactccttagacatgatacagtattcacgtgggtccttgcccatgtgcgtcttgacctcagcatgaccgtaatcgacacggtagatacgaggccactgcggccatgggttgtcacgagctcgctctggcggaggctgcggcagaagctcaaagttggtcacgctcttggcaccatgacgaagcgaggtaccaatgcagtcattgccggtatcaccaccaccaatgacgacgacattcttgtccttagcagagatgtacgcgccgtcggcatgtccggagtcaagcagggacttggtattcttgtgcaagaactgcatagcaaagtgaataccctcgagctcacgaccaggaatcttgagatcgcgagcaacagtggctccagtggcgatgatgacggcatcattggaagcgcgcagggactgcaaagtaacctcatggtcgggaccgaccggagtgttgggaacgaacttgatgccctcggcagccaagaggtcaacacgtcgttgaacaatcttcttgtcgagcttcatgttcggaattccgtacatgagcagacctccaatgcggtccgcacgctcatagacagtgacagtgtgaccagcgcggttgagctgatcagcagcagcgagaccagcaggaccggaaccaatgatggcaacagtcttaccggtgcgagtcttcggcggtcgaggaacgatccagcccatctcgaagccgcgatcaatgatagcgcattcaatagacttgatgcccactggatcatcattgatacccagcacgcaagcgccctcacagggggcagggcagacacggccagtgaactcagggaagttgttggtcatgaggaggcggttcagggcatcctgccactggttctggaagacaagctcattccacttgggaatgatgttcgaaattgggcaaccagtttcagactggcagaaggggacaccgcagtccatgcaacgtgcagactggtacttcagctcgtcctcagtaagacggctagagagctctgcccagtcgcgcgtgcgggtggcggggctgcgatacttctcactgcgccggctgtacttcatgaaccctctggtcttgtcgagaatgagggcagttcgtttcttctccgtcttggagtcactgacgctgtcttcgatatccaaaacgtcgctcttcttagcttcttcatgctggtgcttcggcttctcttcgggaacgctgctgggcagcttgggaagtgagaactccgccttcttagcagcctccgccttggcagcttcctcctgcaggactcgcttgtagtcggtaggcaggactttgacgaagcgaggaagggcacggttgaagtccagaagaatgcgtgcagcgagctcggagccggtgtagtgatggtgatcctcgatgaggccacggacaaaggcaatttcagctgggtcctcaaggccggacacctcaaccatctccatgttgatcttggagtggaagtcttggttgacgtcaagaacataagcgatacctccagacataccggcagcgaagttgcgtccagtgggcccgagaaccagcacacgaccgccggtcatgtattcacagccatggtcgccgacaccctccacaacggcagtggctcccgagttgcggaccgcaaaacgttcggcagccacaccacggaagaagcaggtaccgctcgtagcaccgtagagacacacgttaccgacaatgatgttctcctcggccttgtagacggcaccgcgtggtgggtagataatcagacgaccaccggacaagcccttaccgacatagtcgttggcgtcaccttcgagctccaaggtcacaccaggagccaggtaggcgccgaaagattgaccagcagagcccttgatgtttacatgaatagtgtcgtgcggaagtccagcctctccgtaccgacggctgatctggtaagaaagggtagcaccaaaggcccgatcagtgttaacaatgtcgcactcaattctgcaaggcaagcccttctccagagcaagctcagactcggcgataagcttgttgtcgaggcggacatggaggcggtgatcctgcttgcggacgttgtaggtagcaaccccgggacgcagggagtgagcaggagtcaagatcagagacaaatcgatattctgctgcttggttgttcggatgtcgtccctgaccttgagcagttcagcccgtcccaccatctcattgatggtccggaaaccgagtttggccatgattgcccgcagctcattggccacatagtagaagaagttaatcacgtgttcgggcgtgcccttaaacttcttgcggagttcgggatcctgggtcgcgattccgactgggcacgtgttcaactggacgggattatgtcagcaaccgctccatacagagcattgagagaaaaacatcgcgagaaaaagcaaaacaagataaaacattgcgaaaaaaaaaaggcagaaaaacaaagaataaaagaaaatgtgagtttggggagtctgctcacgtgacacttccgcatcataatgcatcccatggcaatcaaaggcgctgttgcgaaaccaaattcttcggcaccaagcaggcatgcgatagcgacatcgcgtcccgtgcggagttgaccatcggtttggacgacgactcggccacggagatcgttaagaaccagcgtctgatgggtttcagcaagacccaattcccacggaaggcccgcgtacttgataccggtccatcgggaagcaccggtaccaccgtcgtggccagagatcagaatatgatccgccttggcctttgcgacaccagcagcaacaataccgacaccgacctccgacacgagcttcacggagactcgtgcacgagggttggaacacttgagatcatagataagctgcttcaggtcctcaatggagtagatgtcgtggtgcggtggtggagaaatcagaccaacaccaggagtagagtgacgagtacgagcaatgggccctgccaccttgtgacctggcagttcacctccttcacctggcttagcaccctgagccatcttgatttgcagctcatccgcatcagcaagatagttggaggtgacaccgaatcggccggaagcgacctgtttgatagcggatctcattgtatctccattctccaacctcttactgcgctctggatcctcaccaccttcaccggtgtttgacttgccgcccaggcgattcatggcgatggcgagagtggtgtgcgattccatggagatagatccgtaggacatggcaccggtgacgaatcggcggacaatctcagtccatggctcgacttgctcaatcggaattggagtgcgcgattcaaagtcaaactcgagcataccccgcagtgtacagtttttgatctgttcatgctcagatcgggcgtaggcttcataggacttgtcgttcttcgtgcgcacagcgtcctggatgttcgcaatgctgaccgggtcgttgacgtgagcctcaccaccgtcacgccagtggtattcacccgactccggcaatccagggatttccacaatttgtcgagacgggaatcctctttcgtggaaagcaaaggcatcctgggcaatctgctcaaaggtcagaccgcgaatgcggcttgcggtacccgcaaagcagcgatcaatgacgctgtcatcaataccaagggcctcgaaaatctgggcgcccttgtatgactgcagagtcgaaatacccatcttgctcatgactttgaggataccgccgtcacacgaggccttgtagttctcaaggactttttcgtcagacagcggcttacggatgagcttctcgcgattcatcttgaggatgcactccatcgccagatacgggcaaatagcatcggcaccatagcccacgagcacgcacatgtggtggacctcacgggcttctccggtctcaacgaccagggcggccagggacctccacttgttgcggacaaggtggtggtggacaagaccggtggccagaagagcagaaaccgggacgcggtccgcagaggtggcacggtcagaaaggatgaggatcttgtctccattctgaataccttccgtcgccgcatcacagatggcatcgagggcgtccaggtaaccttgaacgcccttctgtttctcgaacgtgatgtcgatgaccttcacgggccagtccttgtgaaccttggtgatattcttcaccgctttgaattcgctgagggtgagaataggagatggcagcaggaggcggtggcactgcgaggggtccatttccagcagattaccctgagggccaacatagcattccagagacatgacaatggcctcacgaatgggatcaatgggcgggttggtaacctgcgcgaaaagctgacggaaatactcataaagcaagcgaggctgctgagccaggcatgccagtggtgcgtcgttgcccatcgaacccaaggcctccttggaatcggcagccataggtcccagaagcagactgacctgctcaaaagaatagccgaatgctttcagacgagcatcgttctggacagtggagtcatccagcgtgacgctgaagtcttcgttttgctcctgcaaggacttgtaaacgttagggagagtgagcagttccttgtccagccaagctcggaagtcatggcggtgagaaacggtgtgcttcagctcagcatcgtcgatgatgcggccggcgacagtgtcgaccagcagcatcttacccggctgcagacggcccttctggacaatggtttcggggtccagatcgatcgtaccgacttcggaggcacagatgatgcgatcgtcgtcagtcacatagaatcggcacggacggagaccattgcggtcgaggttcgcaccacagtagcgaccgtccgagaaggtgaacaacgcagggccatcccaaggctccatctggcatgctgcccattcgtagaatgccgccttggctgggtccatggaagggttatcctgccaggcttctgggaccatgagcatcaccgcttccgggagggacaaaacaccgttgatcatcaagagttccagaacattatcaaaagcagcggagtcggagccgccatcctccacgatggggtataagtagtcgagttcatcaccgaagatgtccgacttcagcaccccttctctcgctctcatccaattcttgttccctcggagagtgttgatttcaccgttgtgggcagcccatcgcaacggctgtgcgcgatcccaggaggggaaagtgttggtagagaaacgagagtggaccagagcgaaatgggcttcgtagtccacgttgacgaggtcgtggtagtactggtagacttgaactggtgccaactggcccttgtacacgatgttcctgttgctgagagagcaaagatagaaccagttcgccaggccaaggacatgagtggcccgcttccgcaacacgtacagctgacgctcgaacagcttctcatcgaacttctcggggtcggtgatctcgggcttattgccatcgccataggcagagcgaagcacaacgaagggctgcataatcagaggctcacgcgacaacgcggccggacccagcaggctggagtcgcggggaacctcacgccaaccgagaactcgcaatcccagggactctgcgatctcctcgaaagtcgcaatggactccttcagcgcctcattatcgggcttgaagaagaggttacccgcagcatattgtcccaatgggggaagctcgacgccagcctcgcgtgcaaagtttttcacgaagaacttgtgcggaatgctagtcatcacaccagcaccgtcaccatctcgtgcgtcggagccaacggctccacgatgggtcatgttgcatagcaaattgcgggctgtaggagagggtcatcaataagcaagtccacggagaaacgcaatggcatagtttttagaaagactcaccatcgctgacgattttgtggctcgccttgcccttaatatggctgtgtgcgtgtattagccatggataatcgcgtcaaatcgagaaaagaaaaattaattaagagtcagaaaattggccagagaaacttacgcagtaaagcctacaccacaagcatccttctcaagttctgggttgtagagaccctgcttcgcgggcagggcctccgcccagccatagcccttctcgggcttaaacgcggagtactcctggggagtctgctcttcaattaattcatttccataggtttcctccaagagacccattcttccgccggtgaccgacagagaatgcgaaacagttgggaggggggtccttatttatttctcagggacgtggttctcgcgatggtgacggtgagggcggggtgagagataggcaagacacgatgtcgtcacgacggctggggccaacaacgataacagcctagcagcagaccgagggaagcacagaggatggctatcgacccagcgtctgttgcgagtgtgagtgagagagtgagggagcgagggaagagaggaagaggaggaagaagagaaagaaagaggtgggcaaggccgggaattcaaatgctcctctccgaaatgatgggttggtgaaagcccggaaaaaaaaaagtctaggactgtggggttggagtagagagcctgcgtgtgccgtggcaaaattgccaatgaatctccagacgatgggacagctggatgacaagctatcccaggagggtctggttcgcagcggccgtgacaataaaataattcctaattactttcacctggctggttgcgctggaattctattctgcccgtccatgccgcttctggagaagctgccacctgcttgtgtccatccattctccgctccagtcggccactacatccatcctctacagtcagggagcgtcaccagagcatcgccagcgtcgccatgcctgcggcattccgctcttccccccgcgatcagggcaattagatcatctaccggtgttgcaagcgctccaggtgaagcttcctacgagcagcgctgcagtggcagagataagacagcgccggccaatcagcggcggggcttttcaacttaggcgcggtcaagattaaagtctggctacgtcaagatccaccagggtgggggacacaggatgcagacgaggctaggcgctgcacgtctgccactagcgggcagcagccgatgcgcatcgaactgcttgacggtaacggactacggtaacgacgcataccgcgtattttattcgacgcagagcagggatcccgccggggacggggaccaggcgccctccgaccggagggcagcgccaacccgtccgcccactcacggacggcggtgcctcatccagtgacaaaaaatataggaaaatcgtctgccttcgctgcggtcgagccgggcggaacgctgcgctacggtgggatcctccccccgaaatccggaagacgtggcctcgggagagcggctgcggtctgctctgagcacgtccctgcatctggcaggctgcatgcataacaggcacacccctccgcagaggatggaaggaaatttgattccttcttctggtcgttgctgctgtcggccatccgagtcccgatgccagaatcggccgaaaagccatggcggaccgctctccactactccgtagagtccgtatcagggaggacaagtcatctcccagatcgcttccgctctcttcccgggatctggtggcgttgccaaggtggggttgtatgcccagatcagttattattatttggacgccgtgttactggcagcgtagagactgtatattggcatccctatcttggcacaatttggtcaacggccacggggatcggcatcgagaaggggaaggggattctgccaaggtcgtatataatcaattggccattggatcctttcaaggattaactggaagagactaccacatccagatccgatgtcttacaatcccctatatccgtacggactcgacggaggagagctgtccgcagttcccctgcttccgacgccttccggaagaggaatggaatcttcgacccggcatcgtttttctgcaaacggtgaaagcatcctgcgcttagttagcctgaggataataggattcgtcctcgcttacggagtacagtatttctttcttttttctttggctgttaggattgacccttgccgcacatccccgagttgtcttccccaaaccgaagtggcctgcgcccgccctactaggggacgtgcatgccgctaaaacgtgcactgtgcagcttcggccccgtggccccatcccaggccggtaagatgcccccggcagatgtaccccacgctgaacactgcccagcgagcgcactgggcggtaggtgccaaattggtggtactttcttacgctccgatacggcgctgcgaggtcggggacaggaaaaagaggaaaatgactggcacggagggcttcccttcggccagagatctgcctcctgctgtccgacaacggaccccgctcgacagaagctctcgtgccggtggtgagacgccaaggaatgcagagccgacgagccggaccatgggtggcgctgcgactagcctcgaggatgttcgcattatggcagtcgttgactcataataaaataaacaagctgcgctgtgtagagcctgtggtatgtggcattaattcgggatcaggactgctgttcggcggccgcacgtgcgctccggtccctctgcccgatgtcggctccccggagccgcgccagagcccctttacctgcgcgctgattggcggctgcggtttgctgcagtcatatctgaaggtcatcaaacagctttatctatctctgctggggctgctggcgctgcttggcgtcctccgtgactggctggccgttgctcaagctcagatgcagcaacaaggttggcgctctggggagtcagatctaacgaaccaacctgctggatttgctgtgttgtaagcgttaagctaggagtaaataaacatctgcaattcgtattattatcacgcctcaggctgccagctgctggtcatgttaccgtaacgatgcattcattcgaatgacagacttacagacttgcagtggtcgtgtgcctggtccaacaatttttttcttataataaattcccaggcccatccaccacagcgccgcggcggctagtttccgacctgctgctatgaatcagtgcgaaatcgcatgtttcctattattcagcatccagtctgctgcccctcaaacagaacaccaccgttccatccgtcgacatggctccggagaattgccataactccggcatccaagcttgttgtcttgctcgcctactatacagactaactaattagacgcagatgactcatccagagttgcagtcgagttgccagtttgcagtgtggatgtcatcgaaacaggcagaatttctgtcgttctggtcttccttgcttgtcctacaaggcactgtccgctttgacgattaactcttggctttccaggtacaagaaaaacaaacaccttgcttcaatatccgtctgctgtccgtctgggcagggagagggaggatggagtcacatgatgtcactcgtcttgtctggtgaaacattccgatttctcccgaaagtcgcctgcgcgcctgaactgtttgagctcaccggccacggcgggtcgcttcctgctgcaaatctgccctgccgcgggaggaaccgggcggtgtaactggacgtcgtaccgccaagtaccaagttacctaccgctgcgaggctgccattgcgaagatcggagtgttgtcgacggtcgaccatcaggcaggaggcgtgagcttcaagtgagacaccatggccacgctgcccacgcaacaccttttttttttgcccctttaagcagccaaatcatgcggtggagaaatcgctgcacggcagtgagaagtcggcaagccagcaggcgacgatgagaatggtccccgattccgtcgacattattgcccaagaatgaggtggaccagttgacctgcgcgtggccataacaaatctgtcgagatcatatccataaaggaggaactaactgcatgaaactgaagaaaagttttcactgtctactaacagcatcttctatgaatagatacgctttcagactggaaactcacacagatcgacagagaatcgcagcaatcagcatcgtcaaatttccaaactcaaatcctgctggacaccagacagccttgctcctccatagaaaccttgacgatcgatggcatacctccggtgtacgtgtacataccttactacgtactcattcattcgactggggtacggcggggtacatacgtggtagtatcgttatctatggccatcaccccactaagcagtgcgagtgacaacttgaacagttcaacttggctgagaggggatttatttttgttccctcacacactctacaagaggactatactgcggagtaagtactatcgaggaatatccgtagtagaatatatatacacttgtttctctattgtacaaaagaataaagcaaaagtacatgcaacattatatgtacactagatgccatccacgcattcatcatcatttatgcctatcatccttgaataataattaaatagcaaataaataagaagcagcaatactagaaaagtagtagttaccagttcatctcatgtttctgtgatggatcagatcaataataattcataataagtgcaggcaaattaattggccctttctctcttcccctcctctcacccctctcccctcctttctttattccttcccctcttcttgttcctgatgtattcgataatagcacctcgatatgattcattattcatcctctcctactctttttctctctatttctctcttattcttttttattattttccatgctaaatgctaattgtatagtaattatcctgacttcttatccccctaagtatgtatattcatacagtacagtacagtgcagtgcagtacacatccacctaggtaggcacagaacttaacatacagttcagtagcagtaatagtgctaggtattagtttgaacagtttaccagaccttacctaaaggtattgattgcattatctgttgatatttaatccttttaggcaaggccaatcaaatcaaccaaatcaattgatcgattgatcaatgatcattagccctgtcttaggtacctaggtgtcttgtgcatgtgccccgcggggaacaaataattctgccttaatattagaaagcggtcagcagtactccgtaccttaggtacctaggtaccttaggtacttacataacttacctgggtatctacctagctctatcaccccaagtttctgtccatcatatgcaggcattgactttctttcctacttgcttgcttgcttacttacttacttggggttgggtttgaaggaattcattttttttccttctgtgtttagaatagctagctagctagcttgtgacgaggggtttcttttcgatgtttttgttcacacccgcgtgaagaattaattattgtttttttttaaagcaagacttgtcacaatgctttcgcttcctctcattacaccgcgtgatgtatgtcttcttcttttttttctttatttctattttttttatgtgatgtggcatgcataactaatcttgcttgtgtacagtctcacgaactctggttcggctcctcccagccataccgctcctcttcttcgtccacgacctctacctacccacctcacacccatcccaactcgtccgaatcgtctcgtcgccaggcccagaatggcccgccttctcgcgcctttatttcctccgcaaccccgtccgacagcctcgcggctctgctccttgaagaacgcgcattgcgcgtccgaaaacagaatatcgcgtcctttggctacgcctggatcaagccggcgggatgtcccaagaccatgctgggtatgagggaggaggaagcggagagggaggaaggtctcgctgcggccgctgcggagatgaatgctgctgccgcggctgcaggcatggggttagatgcctttggggacacgacgcagggacagctgggtcttgtcggagatggagtggatgcggatgagctagagagggacctggacgatgatatccccgatgcggatgccgaggggcttgttgaggaaggagaggaggggttcgaggaagacgaagatgtcgacgacgacgagctcatggagcgcaatctcgacgatgatatcccggatgcttttccagatgacggtgatgatgacggtgacaatgatgattttgatggtgacggctttgacgaccagcccgatctggacgatgagattcctaccgccgaaggagacgaaggagaagaagaaggcttcggagactcgatgatgggccgagacctcgacgacgatgtccccgacgcagcagaagaaaggagccagcaagaggaagaatggcagcatacagacacggaggccgaagacgacgacgatgacgaccgacccgatcccttcgcggagcattttcgcatccgcacacccggcagcgggcgcggcctgcctccgcaactaccgtccgtgacgcgcgagacggaagcgcagagacggttcctacaacgctggggtggtggcggcggcggcggtggtggtcgtgattcagacgtcttcgacaccagcggaatgtcgctggacgatgacgacctccgcgcatcgatcaccagccaggaaagcatccgacgacctagcagattcggtcgacggtttcccagacgagggggaccgagagacagtctcgactaggagctacgtccagaactgtgtacctttaatcgggttatgagtatttcattttaatcaatgcgaattgggggtaaggatagatatggtcgagcatggcgtttggcaaaagggtgaataaaggaatgaattaatgaatgaattaatggtgattatgcttctttctggcatgaggaatcaaaattcttctgctacttgtaataataattgcaatgcataataatttcacaattttgtagttcgacctgagtagatgccaaccatacttctatgtatatgctattatctacttagttccgcaggtgtaagaagactcatgtatggaaagatttacattaagattagtcctccacacgtgctagagtgcaggtggaggaggtatgtatctatctgtatatgattaactatacatatgtgatgtggtgataaatagttggaatatcagccacacagcatggtggaatatcctgtacctccggtagatggaagatcaagagacatttattgcgtgacatcgtggcatgtagccatggcagaggtcacagatcttcctcgcctcctggatggccatccatcgcttcgtgcccaatgacaaacgcaatatgcagtacgtgcaaacaccgaagcaaacaaaagcagccgtcgatcgacaacagcagtcagacctgtcttccaacaccacgaccaactgagccctgatcatgacgtacagaagtcacaaaggcataaaagcagttggagtcatccctggcagaagagaactatgaccctcgaccatgggcgaaacagaccactcgttggagggatgttgtaacaagtcttagaaagaagagaacttgtagaaaggtgcggtgcgtcaatcatgtcgtcttgcaaagcaaaaagcaacgccaaaacgcctagaaacgccaagtccatgcgcatcgtgatgagagagcgaagcatccaccgtaagatgttggaagacaatcaggttgagcgaaatcgtttcggttaacaatcgagaggccagagtataagtccgggggcctctaacagtcaaatagccacaacgccggttttcgtcgagagaagcgctcagaaaagccatacgtaggcaaaaaggaaaaagacggcaatgaagaagagcaaccacacgcgccagccgacgcctgtccgctcagccatgcgcaacatccgattcatcgtgcctcgaagccgtatacgggttgtgtcaaaagtttcgttgagggaatcggctagagtgctcgagctccggatctcgtcgcctatagcaactgtgagctgttacaaaagtcagcgtcggtgtgaccataaaggaagaatcaaaagtaactgacatctttcagcatctgcacctttgccgttatcccggcgatattttcatcgttttgggattcgagcgaatccagcacggcgtcagaatagtgacctctgaagcacacaacccatcagcatgtactcatccctcattgaccattctcacagctcccccagagtagcgaaacgcaactgaacctccgccatcaagccacaggaaccacatacttggaattcggcgtggcagctcgatagccagtactaccagtactcagcccgccattcatatacccatcgctgatagatcccgagtatcctccataaccgccgacacgtcctggcgatctgctcgcaggccgtgagcggccggtgctgctaccactgtaggaatcgaagagcgacgaagaagcgcgggggtcacgttggtgcagtgaagagtgtgggaatctggccaagagtcgattagctggcatggaaacatgaatcgcgtgggcgacgttatcataccgtgatgccatgatgcggctgatattaatagaaagtagttctcaggcgctcaccaataaaataatttcaaaccagatagaatcgttatgaagcagcaaggctcatatcctcatggtggatggctgcttgtttcttgttctgttcggagatgattttgcggcgaaaaactatccagcttgctgaccgtttcctttctcggggagagccgaaagctgccatgtgggagtctctgcgtgaccggaatgggaatactgtctacaaaacaaacctgagcacagtttatatggcacagttagaagttaaattacgaaccaaaattatatatcatgtttaccgtagttgcatttctctctgtcctgataaaagtagcttttccacgaattttgttgtcgtttggtgtgggttaggcagacagcatggggtaagagcttaccttggcagcgctcgctacattagaagcttcaaatttactgacaagggacagaaaaatcaggaaaacaatttagccgtaaattttggtttgtcactactaaactgagattgtgggctttcgaaacgtaattttcatgctctctgctagaacctgcagagaccatcccagtaatgcatgctggtctgctttgcccagccagcgctacatcccattccgtacccgtattttgcatgacccaaatacctaacgaccatatgaaatttgcgcctgattaaacatgccgatcagattatccctcccaagaatgtcgttgccgtaactggaaaaaaaaggattgtttgtttggcgtttattcgttcatctcgtcctcgttgcccagctcaaagtcctcatcgtcctcgtcatcgtcatccaattcaccttcgccctcggccttggccttttccgcggcctcagcaaagtcaatcatcttgccacgggtccgtcgacctccttcgatgatgttgtccgtagagatgggttcgagattgtcgccctcctcctcgtcttcatctgtaagagtcacatagcggtcagtagagtcctaatacatcatccaggtagtaatgcaggcgacatatctgtcgtgtcctgcccacgacacaggatttaccaagatgaggggaggataggttacacaccaccctagacgcgtgatatgttagcaatttatagtcgaattataaggcgctcgacaattgcgcgctcgtggttgacgcaatccgacgtaccaggtcttcttcttcaatggcgctgtcctcgtcatagctttcctcctcctcttctcccatgctcacttcctcagcaggagtgtagtcaacagccctgccctttcctttttccgcggccgcggcatcggggggattcgccgctgggtcggcgctgagaccagtagtctgatcgttgtcacccatgatgagaggtaggaaatgcgcgcagcaagaggtgtatcgttggcggggaggaagaggctattttgtcaccagatggtgtcggggaagaaagcgcagagagatcaacaaggcggattgagaaatacgcgatggagaagagaagaaaaggacagcagagtgtcgtcgtgcagcgtcgcaagggagagagcaagctcgatggtccggagggctcatcgctcccatgcgctgctcatcttttcattgggcgggatggcccggggctcaacgcgctagcggctgaccgcctgcagaaagccgcccgtgactggcgctgcccgatcgcagattaacctaaatcgactctttatgcaagggaagacagtgatctctgcccctccgtgtagacaggaattgaactggacgacaaggtgggaaaaataagcaaataaaacgagcagctatcgtttccttactgttgaaatggcaagatgacaagacttggatagtatggtgctagctaggtatctattaatctttcatgctggaatgcttcatgctccagcaaaaacaaatgttgactggtggcagtgtccatcaactgaatactaacccaggatagtaaattgattggcgcgccttcggagaaagtggctagatatagtttatcatgggctggtctaattttccggcctcgatctgtgtagatctactgctgatccaatcaacttgaaggtacgatagatcttgtctccagctgtcgaaaggggaaatacaaacaaggtacggttttggatgtcgaaaatagtgtattgatccaggctttggaagcattggtgaaacaatccgttttagagcttagcatctgggatatattgctaaggaaaccaacagctaaaattgattaagccgcccagcgaaggaatgaacaattccctgcgcacatacctttatactattcttgacgcttctgacctcattaagcggtttgagctcctgaaatgtcccctgatcagcttcgtgggtgaaaacagaggctgcaactccccactcctaggccaccatcttcattatgattggttgtagcatcaatcgagactccaatgccgactggatgacacgtgcgattttgacgagaagagattcgtgtgaatcactctgttctaatctggcagcgaaagttactgactgcgagtggacgtgaataagactgagaccgtttgggtaactgttccattcagtttttttgaccctcatctcatcaggtgtatttgtgaatttttgcctgccctttcacctttgcatcctcctttctcttattgtaaatagtatttccacccggaatgggcttgacctgacgtgaagtgttggggactgattggcgggagggaatgtggcaaccatggttgaggctggtcagagcagctgcagaatcttcacctgaccaggcggaagcggcatcgaaaaaggaagaggtaatgagcgttctgttgcagcgctcgctgggacacggccccggcggcgagaggagctctcgagaggaacgcaagcagtgttcatccgccaccagctagctggcagcgctgcgctggagctctgtactccgtagagtaagaaagggaagcttctttgcggcccgacgtggcggaagaggcagcgagcgtgtcattgtcatggtgacggcgacgacggtgccgccgcggggtcgccaaagcagcgcacagaaaattacgtcatgattccaccccaccagatcgcaacacacagaagcagcgagatcgaggacagaaagctgctgaaaacagcagaagatcgcaacgccggagacggacgcgtccagcagctacgagggccttccagcggcgcccagcattccctgtctggcagcggctggggccttctggcagccagtggaaggtgcctggcaggcctagaaactcatggatgcccatcgaagcgcccgcctgctagaagcttctgggccactcagcttcaccgcccgcctatatcaatgatttcgcccgcacaaccagcctcgcccagatttcttcatttcacacacacagactttccctgaggacaaaaatatcccatcacctcgtctccctcacccctcccgactcgatacccctctcgagttcgctgtacattagcctcgtctcacgtttttcttcctctctcacgtcccttcttcctcctgtcctcacatagccgttcacaatggcccccgccgtcggtatcgacttgggcaccacgtactcgtgcgtgggtgtcttccgcgacgaccgcattgagatcatcgccaacgaccagggtaaccgcaccaccccgtcgttcgtcgccttcaccgacaccgagcggttgatcggtgatgccgccaagaaccaggtcgccatgaacccctccaacaccgtcttcgacgccaagcgtctgatcggccgcaagttcaacgaccccgaggtgcaggccgatatgaagcacttccccttcaaggtcatcgagaagaacggcaagcccatcatcgaggtccagttcaagggcgagaccaagcagttcaccccggaggaaatctcctccatggtcctgaccaagatgcgtgagactgccgagtcctacctgggtggcaccgtcaacaacgccgtcatcaccgtccccgcctacttcaacgactctcagcgtcaggccaccaaggacgccggtctcattgccggtctgaacgtcctgcgtatcatcaacgagcccactgccgccgccattgcctacggtctcgacaagaagggcgagggcgagcgcaacgtgctcatcttcgacctgggtggtggtaccttcgatgtctccctgctgaccattgaggagggtatcttcgaggtcaaggccaccgccggtgacacccacctgggtggtgaggacttcgacaaccgcctggtcaaccacttcgtcaacgagttcaagcgcaagtacaagaaggacctgaccaccaactcccgtgccctgcgccgtctccgcactgcttgcgagcgtgccaagcgcaccctgtcgtcctcggcccagacctccatcgaaatcgactcgctcttcgagggtattgacttctacacctccatcacccgtgctcgtttcgaggagctctgccaggacctcttccgctccaccatggaccccgtcgagcgtgtcctgcgtgacgccaagattgacaagtcctccgtccacgagatcgtcctggtcggtggttccacccgtatccccaagattcagaagctcgtcggcgagttcttcaacaaggaaccgaacaagtccatcaaccccgacgaggccgtcgcctacggtgctgccgtccaggccgctatcctgtctggtgacacctcctccaagtccaccaacgagatcctgctgctcgacgtcgctcctctgtccgtcggtatcgagaccgctggtggtgtcatgactcctctgatcaagcgcaacactaccatccccaccaagaagtccgagaccttctcgacctactccgacaaccagcccggtgtgctcatccaggtgtacgagggtgagcgtgcccgcaccaaggacaacaacctgctgggcaagttcgagcttactggtattcctccggcgcctcgtggtgttcctcagatcgaggtcaccttcgatgttgacgccaacggtatcatgaacgtctcggccgtcgagaagggtaccggtaagagcaacaagattgtcatcaccaacgacaagggccgtctgtccaaggaggagatcgagcgcatggttgccgaggccgagaagtacaaggctgaggatgaggccgaggctgctcgtatccaggccaagaacggtctcgagtcgtacgcctactctctcaagaacaccatcaacgagggcaagctcaacatcagcgccagcgacaaggagaagctgcagagcgagatcgagaagaccatcaactggctcgacaacaaccagaccgccaccaaggaggagtacgagtctcagcagaaggagctggagagcgttgccaacccgatcatctccgctgcctacggcggtgctgctggtgctgctggcggtcctggtgccttccctggcgctgctggcgcggctggtgccactcgtactgccgatgaggtcgaggagcgccctgaggagcttgactaaattgaagtcggtttggagggttccccatagagtagagattgtgatgtgacgacgatcatctcttatttcctttgtacttttctttttatttcctttggtcattaaacaaaattcacgtttgcttgatgatggtcgatcaacaagtaaatgctggcgctgctgatgttttatgaattgggcatttgtttcttgcttgtcatgaatttgcatagatattgagtttgtgggttgtttatgaaatacaaccactgctctagtcttagctagggtaaaaaagtctaatacgactggtaatattcatttgttgttcacgtagaaatagaatttatctgtttgtagatgagtagtagatttaatcaacgttacctcgtttataatttgagtgggacatttttttttctttcggaaacctcgcacaacactgtaagatctgaattgtgtagcttcggtaactttccattcctaatatcataccaaagaaggcaaaaaagtcgagatcagacccagtcttccgtttactggatatatgtaattattcaagactcaacctcccaggacttttctttcttgttccttaggagaggaaaaccgcacgggaatgagtcatgctagttaattaaattaactagctagcttgcttgtttgcttcaactctcatcacttagtcactcacatataacagtatctagctagctatgtacctatctgtctatcgcacacaacacagtcaatgatgttatatgtagacgctacgcgaaactcctaaaacagcatacataccatttccgagtctattcatccattcaatcacccatgcactcaatcaaccatccattaaatgacattacattatactattcatacatagtagctacaatttttacaaccccttaaactccccgttccaccacctccttaccctccgaccccccgtctccaggatgctcccgaatccaatactcttctcgtcgcggcccgcctggacggcttgttcgcgctgttcgcggcggatgcgcaccacggccgagacggcgccgatggtgacggcgaaaatggggtcgccgatcctgtgatcattatcgtcagtgggaatgtctgggtttggagttgtatggggttcgattaattgattgattggatggtctaggtaggtaggtagaagtgcgaatgcccggtggtggtggtgatggtggtaatggaggtgggtagtcgtcgaataatggatggataagttcactcaaactcacttggatatgagatacggtgctgcagaggacattattttatttagttctcgtcgtaaatcaattgattgattccgagctctgtttgaatggaaatgataggataggataagatatcgctgcgctgatcacagtcagtcaactcagaagacaagacaagataaatcaattcgagcgagtggtaccttgaggaataaccagaatgcgtattcgagcagcagcaagcagctcgctgagcacaacagctcgtcaatgaaatagtcaacgattcctcaagtaatcaagtaatcaagtaagcaatcagtcgagggacaataatctcagtggttgctaatgaattaattgataaataatgaatgaacaaataaacaaccccatcaattcttgacactagatcgggtaaacattacttttcttgcttccttccttccaaactctaggttgttgtaggtattatccgagcgaatggaataattgtccatagcttaggtaccttcctagctatgctgctatcgcttttcgccgcggtgttggaaagctgccgtggggcttgtcttagactcggtcaggtcacctgatcacagcgtccatccagtcgacccagtctaatgtactgtgacaggacactcacatgcctaagtctaggtgcctagaattgctgatgtatttattctgttcgcaatttgactctgtgccgtttcgcctcggctagctgtattatttacggaataatccatgtgaggattcttgctatgattcactgagattgtgcacccaacaccgctgaggttcgatattgacaattaccataataccgatgagatctagttcttaggaataatttcaaagtggaggatctcgtgcattctttagatcatacagttacataagacagaaacaagcccaacacaaatctctatataaaacatacagaaaaccagaccacgccgtggtctgaataagcaatgtcaaatccttcattttcccatactctcccaagtttacacaatctttccaaacgccgggatcaaagtctgtgccagccagaagctgaacaccaacttgggtccggtcatgagcagcttaggcgtcaggcccttgaagaacgcggtgaaaccctcgttcttggccatgctggcaacaatcctgaatccagattccgggttctcgaagttgcggttctggatccgggtcttgatgacatcaagaggggcagacacaatcagagaagcgctggcaccgaagatggaagccacgaagttctgtgtccacgacgccgtgttgtaatccttgagcccgaagacatattctttagcgaaggccgaaccaccgaaaagctggaagataaagttagcatatcaacatctcctcaaccgaaaacctccgacgtacggcaaaagatcccggagcgttacgcgccgccgtccaaccagcgccacgatacagtcccattccctcatcagcgataatcttgaaaagaccgcgaccccggaacgcttcagggttggtctgtcgcttaatcttcaggacgtccaaggggagcagaatgatttcaccgataccgatcaaactgtcgcagatcagcacctcaattatataaaaattcagaccgaaacatcatacctgccagccgtagcatgcatgatagccttgccagttccctttccaaaggcgttgtcgaaatccgctccgtggtgctttgccaggtagtcccggacgaaaggctggccgccgtatttgtatatccgttggaggacctaatgacgacaataagtatatgacaggattcagaagtcgcttgcttgcgcatgttctgtaccttgtagccggcagcatatccaagacccgggaacagcgaagtgaatttgcggacgatgggcgccgaggcatagtccttgaagatgacctggttcaacgcactcgcggacgtgatctatgtgaaagaagcatgtgtaagccctggtccatgtagaaaataacggacagccagatgacttactcttccctggttgctcatcaatcgcttggcgatggtgtcaacctgcagacagcagtcagcatcagggcgcacgactgcagatgatgaatcgtaccgggtggaaaacgagcagctctgcgacaccggcagaacctggttgatttaatcagcacccgatcaattgagggaatatcctggatcgccctacctgaacctagcaaccgagcagtcccggattccttcttgacatcctttgcggccgagcccgcaccgtcctgagcgacggcaggcgacattttctcgtctatctaattgcgataaactagagagggtgatagaaacagagaaagagtaaaaagctccaggctcgaccgcggacccgacgatcaagaaaaaaaaggagagagggaagaaggcgatgactcgaactgcaggagaaccagacagaagaaaatcgatcacagtctgctccggggaagtctttcgaaagctccggcggactatccaaaattttggggcccggaggcctggcgaggtcggacccgctagtctgaaaggggcacgcggccgcccgatccaagcccgacggctctgatcgcaccagcctttagcaatttggtaattactgcagcggttttgcagatattattagctaactattgactctttctcgcatcatttgatggccaagaatgtctggaagaatgaccggaagatcgccttgtttacagcgcaactgacttatggactttctacttcaaaggcgacggactattcttgcatatcggatatcctttcacgcaacagaagcatctcagtcaaactgagatgttgactactggtaagtgttggaccacaggaatcaggatcagaatagtcatataattcagctagctgaacttccacatatgatgcctgcatccgataatataggctgacagaaaagcaaccgcaacaagagcggagatatagcagggtgccagcgggcactttgactgtgtagctactttgcgttcactgctaccggcacacccaaagccgactcgtgccgagctgtgtctgaccaatttatgccctgacagactcgaagcttcaggaaagaaagcaagactgcaaattataagcgtgataatttgcggatcgatggcctttaaaacaaaacagctgcaacagcaagcgttgacataacgtggtagaaatcaaagacaagaacccagtaaaacgcccggacgatgaaatcccacccccgccctgtcgagccagtctcgttacctcatagccagttcgttctcactcggagttacgaataacacccagcattctaatgaacggaatgcaagttggcagcgctcgcacgtttatagagtaactcaaagctcttagcagtcaccaaatgtgttctcgccagagtatctgcctccaggttagctacgggacgttacacaatacgagtgacacagggccacgcacgtgatgtacaggaatccatcctcatccttgtgctcttcgtaaatgctgctcatgagggccgcagtaggcgggagcacctcgtcgacgaagatgaagatggccttctctggcgagagcttgatgcgcttgcggatgacgtaaacgaactgaccaacggtgagatctgcgggaaccaggtacttcttcttgtcgatggttgcgatgtcggacttctcgaccttctcgcagatgacctgtgtggtgaaacaacgattaatatcagttattgacgggctgacgtcgaccgataagcggcgtgatcaacgatgtaacggaacgacgataaaggagcgcaacaacggcgatggacacgtaccgggatgcgatccgcatatttctggcggatacgctcggcctcagccttgcgcttctcgaaggggtgctcgtccttgaacttggatctcatggtgacggagttgcggtcactgacttatcagataaggcttagttgaggcagtcgatggacagacgaggcggtggtctgtagaaagctacgcagagcgacgatgcagagatgtagaggaggatccaaggcagcaagaaaggaagggagagatgacgaggagatgggggatgagtaacgcaggcgacgatggatggcggtcgggtcggaaggtgactgggactcttgctactgactggcaagcatgaggcaacagccccgcgtaggccaggccgggggcggacagagtgagagccgtgaccagtcacggggcggagtcggtcggtcgctttcggcggctgccagcaaaggcggtcagctgtcggttcctcgccagcagtcctggcggtgtgcagaacgaggcggaaaacaacaataataataaataaatactgatattaatcgcgatgaatcgatagaaaataatggacaatcgaagctcttttcctctagtaatagtacaatcccatgctgcccttgatcctcctgcttacagccaccctgcgttggcccggaatacaccacgagaatcgtcatcgataagctcccgtgactgggctgagtcactggacccgtgtcatgccaacaagcatacatgaccagagaccattccagaggacaatctgtgcgattggaaatctcaatattaaatagtaaagaagtatttttatgctgttctcgtattggaacattctggcagccaccttcctcatctggtctccatcatgtgctgtcaggtgttttggtcccacaagttcaagagacacatcatttatttgctgcagatggcttacattggggcgagcgtgtaatcaatacttggtattcaccagcaaacctagctatgtagtattgttaaactcgaagactaactccaggctaattaattaaagtattagtatatacatccaaccagtatgcatccagtgtcaacagcgattaattcattctcatcattaacttctggaatatatacaactacgagttctctaacttgggtatcatagcagcagtcagaaacatcgatctgatcagcgaaattttcaatccagctctgacgataatatttctatccgaaaaaaaaaatctagacaaaacctcctcatcacggtcgtcatcagtatcgataatgcacaaaacctgaaacaaaaaaccgtaagcgtacaaaagtgtcaatcgacatagaatggaaaaggggtacccaaataacgccgacgccatgcaaatgctaatgaaacataaaaaagatgagataatacaatctttggcagaatcttccgccacaaagactcttgcagtcgatcaggcccttgctttcctccttgccttcttcgcttcaagtggtgcctcacagatctccgtccaggcgtcctcgaaaacggtcttctttggcccgatctgcccctcatagaaattcaacttgcggaccacttccaaagcccccgtaccaagcgacacggtcttgcccatgatgatacattcagacacaccctcaatgaggtcggtacggccagctccaccggcatcgaagagatgatctgcggtcttctcgaaggaggcgagctgaaggaccgagtcccgcatctttgccagaccaaagcgagtaatacctaacacctcgcctttgtatgtcatgacatctgcaagaagctgcatgtgacgcggatcgatacccatatccttcatgacatcgctgatttccgaaatgatggtgacacgggcagcttcaatgccaaggacgtccttcatctccatcacgttattggtgaaggtgcgaaggccatcaacaccaagagtggtcatacagtccttcaacccatagccttctaccaggagactgttcgttgtagacgtgtcgtcggtacggatgatcgcccgcttggtgtgggggtgcccgagaacctggatctcgggcagtatgcgcttgagatgcttcaaacggaggaatggatctgcgctggttgccgctatctccgtcttagagagggacgccttgctggcagggtccagatccaaatgaatatgaatatgcgaccgagagtggcggaacttcagatcgtcggccttgaagcgtttgtgtctcttgatcgcctggaggatatcctgcgtattgagctcaagcgccaggtcgcgaatcgtcttccagttgatcttgaccgtgatgtacgcgtccttgcccgtccaggtttctcgaacataatgaacaatgtcccgcaaatatgtcttttcgatcctgcccttaacaattcgagccgcgatgatattgtccttggtcacgagctcgcaggtaatgacgggagtactgatctccttggaagcgttgataatttctttgatacggggcacaccctgagtgatactcataccagcgacacccgcaaaatggaaagtcttcagtgtcatctgagttccaggctcaccaatggactgcgctccgacggcaccgacagcatggccaggctcgacctgggccttcttatacttcgtcaaacacgatgtgataaaggccctcagagttctctctgataacttgccagtgtggttcaagcctttcctgctcctctcgtcagacggatcgaaattgccgccgcgagagatcaatttgtccgccttggtttgaacgtaagccttaatcgactcaaggaaatcacgctcactctcgtgctggtcaatgccgtggtcgctccgatccatgtagtccagttcattacccagaagatccttgcgtacaagcttcgctcgctccttggagagcatttcctcgcagacctccatgatctcggaaggcaacaaactccggtcattgttatcataggtcgtcgactcagcgtggacgaaagttcgatcgaagtggacaggtttggctttaccttccatgtccacaggatccaggttgtcatcaccgtattggaattggacaatgctagcacccgacgttcgaatggtgttgtcgtatttgctcgagagatcttcgagagacttcatcagacgacgagacatgtaacctgtctctgcagtcttgacagcggtatcgatcagaccttcacgaccagacatggcgtggaaaaagaattccgtaggtgtgaggccagaaaagaaactgttgcgaacgaaacctttcgacggaggttgacgagcattctttgggaaatgaggcagtgttctgtcttgaaatccgtcctggatacgctcattgctaataatctgctgacccacaagagcaaccatctgagacacattgatgctggaaccttttgaaccggaggtggccataattagaggtgcattgtatttgctcagctgagcaatacattcatctccggcttgctgacggactttggtgaggatggcagagagctggctctccatggtctgcagctcatcacagccaggcattttttccagctttccggccttgtatttggcgatgacttcatcacactctgcgtaagccttttcgaccaactcgttcttcgaccggatgagactttcactagggtagacgtccgtaatgccaatagagaaacccatgtttgtgaaccaacgagccgacagcctagagaggcggttcatgccctcagccgcaactgccgggccaaagtctcgtaacatgatgtaaaaaacattgtccttctttccggagccgattgtggctttgtccataacgccacacatgacctctgagttacggatgacgagccaaccatcgttcggatccaagtcctttggacgaccatcttttggctgcttaaattctcgacaggcggcatccaagttcaccatcacgggatcgtccttgttgggacgcatgaggacattgaagacctgctttccggtccaaagcatctgcggcttgagaatagcaggtggaggaaggtcgaaccgagtttcgggaccgagcatcgagatgcatatctgcgtaaacgatctccgatcgaagaaattgtccttgttgctcaaaatagaggcagcactgataaaatcttgaatcgctccaatgataggttctccgttctttggagtggccaagttattcttcacccccatcaactccatcgcctctgccctggcttcttcggtctggggaacatgcaagttcatctcgtctccatcaaaatcggcgttgtacgggttgcacacacattcgttcaaacggaatgttctgtgtggccgaacttttgcaaaatggcaaagaatactgagcttgtgaagggaaggctggcgattgaagagtacaatgtcgccatcttcgatatgacgctcgaccgtatccccctcctgcagctggtcggccatcatcttgagattgccgtacttaaggtagagcttaaaattctgtcctttcttggtaaggtagtttgcgcctggccatttcttcgttccattccgcactctttgctgcagcttttccttgttgtatctggtgacgacctctggataagtcatgtttttcgccaccagctctgggacagcaacctcgtcaattcgcaggtttggatcaggagaaatgacagtccggccggagaaatcgacacgctttccagacagatttccacgaaagcgtccttgttttccctttagtctctgcacaaagccgcggataggcttcccaaggtctgccttaagactgggggcgtcgctattaatataaactgcaatctgaagctgcatgtagtcccaacattccataatagtccctattggtgctcctttcagcagtgcattcttgagattaatattgctctggacgatgtctcccagcttggcagtcaggtcatcttcagtcgacgcagcgtcctggcccactgacggacggatgcagacaggaggagcagggataaattgccacaagaacatttccggacgagcttccttcgggtccagtccgagtagttcgcaatctgtatcggaaatcttcttgaacaaatttaggacacggagggcgttcagatcatcttgggctttcttgtaatgtttttcaacgtccgggtttgtgtttctagcttcttcaaaagactggtcaaaaacgatcttgctgggcggcgtcacttttttcgacgaggtagacgcgttaaaggcgcggaacttgtcatgggtgatcttcaatgcgctggaaccggccttcttcacgacaccattgatagcaccacacgcctcacagacccgggtctttctgcagcgttcgttgatttttttcgcgatttgcatgcgtcgtagattatcaagaccaggacgacgcatctcccggaggaaggcgcggcgttcagactgcggaagcagaattctcgaacactctttacaaatctcctgcaagatactgatgacacgcttgaaataaccgacatggaaagcaggcaggaccaatctgacatggccgaaatggccgttgcaaacttgaagggaaccgccacaggtctggcatgttccggtcttgttcgaaatacccatgcgcgcgtcgagagggccatggggaaccgccgttctgccatgttcgaggtcaaagaattttcggtcggaaacttcaacaacggcttggctgacaatgtcatcattggacctggaaattcacacgtgcaaatgttagccaataaccccgagtgggaaaaaaaaagtagcttcgaaagatttcaagaaggtgtttcttacagagcaccaaatttcagttctttgatcactttgggaacatggtcgatgacctgggccttgcccaggtccacctgcacaccttctggaggctgcatcgtcgttgtcaagagctgcgcatggcaagcgaacgaagaccgctctaggctttgcaggcagcgagaacggacagactctgttcgagggggaacaccgcagacggcaaggatgggattgggggtgaacaggcctgccgttctgaaggaccgtctgcgcaaggcagggaaaacaacgctttgagggggaagatttgaagatgaagacgaagtccgatgaatgcggcggcggggttggccacgaacttttttctggcggcaaagctctagctccggcccctccggcgcccgccaatcagcgggcgcccgtctcgggccaggcgctcgggagcttcggcggagcatcgtaccagcggcgaactgcagcaaacaggacaaactgcatcatgccatgcatgtcggcctgcgggctggcgggtgagctgacactcgcttccctccctcttgggcctgtctgcccttctaattctcttcatttggatttctccctctcgtcaaacggagcccctacctgactggtctgaattggaggctaatccgccagctttgccgatttcgcgttgaaacatggcgtcttcccgactgtggatgcctctggcgaggtcggcctatcgcccagctttgcggagagctcagttttcctctcgtatattccagggccagtataggagattctcaaattggccgagggatcgggaatcggagaagtacacgatttggaggccctatttgcgccttgcaattggtattccgttcattggagctctgatatattcgatggtatgtcccatctggcgcattcctcaacggtgcgatttttctcacagtctctaacagttgactggtgatgtcacggaaacggagtcgccgtccattgccgaaattgatgagacccttaaacgccagtcgaagatcgatgagtcctccccgatgcgcttgcggatggagaagttgattaaggagcaccaaaagaagatcacggaggagctgagcagaattgacggcaaatctttccggactgatacctggactcgtcccaatggtggcggggggatatcatgcgtacttcaggacggaaatgtcttcgagaaggccggagtcaatgtttcggtcgtgtacggggagttgcctcgttctgccattgagaagatgcgcgcagatcataagtcatttgtctctgcggacgtgcagtctctgagcttcttcgctgccggtctctctctcgttctgcatcctcataaccctatggccccaacggtgcatttgaattatcggtattttgagacatcggacccgaaagatccgatccatggagagaagaattggtggtttggaggcggcactgatttgacaccgtcttacctcttcccggaagactgcaagcacttccaccaaaccatcaaggatgcctgcgacaggcatgatgcgacgtactaccccaagttcaaggcgtggtgcgacaaatacttttacatccctcaccgccgcgaagcgcgtggggttggtggcatctttttcgacgatctcgatgctgagttcttacggagctcctcatcatcatcgcagaacccgcaagagactctctttgccttcgtcagtgattgtctagagtccttcctgccctcttacgtacctattatcgagcgccggaaggacatgcccttcactccggcccagaaggagtggcagcagctccgacgaggtcgctatgtcgagttcaatctactctatgaccgtggcacaagcttcggtctgcggacgcctaatgctcgtgtggaaagcatcctgatgagcctccctcgcacagcaagctgggcctatatggaccccatttcgggaaccaagacagaggctggggatgtcgaagaggaacaactagatggtgaagataagtcgatggaacgagaaatgttggacgtgctgaagcacccccgacaatgggtctgaagaattgagcatctcccatctcacacctccacctctgcggtaattccattctatgtacttgtatatatatgggccaaggccatgtaaaagtcaattccaaaataatatcaaaatgtactgtacctaacctaacaacagagtttggataaaaatgacactgcactgcatactgcatcctctgttccatctttatgatcatagaacacaatttatgtaatagaatggctatgatgcaatatatccatatttgctgtagatacagatgccaaattcgagagagatgtaccaaaaaaatcgccacatatgcgcaacactgaatatagaacagaggaaacgaaagaaaaaaaaaaggagcgcttgaatgccacatgtaggtgagccataggagccaaatgatccggaacactatatctatctatattattctgggacttatgccagctaagtcagtcatgagaaaatcaatgtggtatggtgtaagcccccgtccgtgtttgcctcaaaacgaaaaaaaaaagtcaatgctgtcgccagaccgtgaatgtaagatggaatagaagtgacagcaccaatgaaaaaggggaattcgagaatctgatgtaagttaaccgcgtatttcgttccccccttcatcagttatttgctactattttgcactggagacaatgctcctctgcttcgcaagccagcccctctgtgcatcggccccagagccggcaccagtcgatgccggataacgataccgtgacacagtgacattgctgttctgcaagcgaccctgaagatcataccacgcggaagacataagggagagctctcgtgacaggcggcggatggtgtcttggagctcgagctacgggattcattgttagaatcattcgtaacagagctgtgagaaacaaaatttgaagtctggggaaacccaggtaagaatcatccattagacttacttctcgctgtttagatatggtttcttcctcattggcgttggcttcctcgaagtgtttgattcgctcctggagtgacttgatgagctcattctgttgatcgatgtgctataagaccgttgcaatattagctattgatcaataaagaacaccgaaaagataaaaaccccagaaattctcaagtagtcgggggaaataagggatgatgcacaagcctgtgatctgctgcatcaaatttcgagctgggtgcggccatcgtctccagaggcaagccaacagagatatgtattctatggatggaatagattgtctattcctataaagaaagataacctcttccaagcaacaattcgcctctgatgatctcgggaagcagatgcagcgatgggcttgagcggacgtatgcagcaagatccttgacaggcatggcttcgacgtgaagttcaaaacaagaaacatgtttactgacctctgcacgtttcgttaatttctcaacactcttttccgtaacctccgcaaaacgcttcaggagttcggtgccagacttctccagtgcatccggattttcggcgttggagagagcagcaaactccgcgagcaatgcctgcatctccttgattaagtcttgatcttcggcgtggatttctgtctgcttgttctcaagtatcgaccgcaactcgtcacgttcggcgcagacttccctcacgagagcctggctggcatctacttctgcctcgagatgatggatcttactcgtaagcgcatcccagtcacctctaagcttggcgatctcggaagaattagattccttcacttcgttgagcatgtccaatttttccttgttgacaaggccgactggcgcagtggtcagggaattgatcgactagattgacaaaagcttgtataaagaacttacgctctgcccttgcatcttcaagttgtcgctttgtggtgtcgaccacatcctcggcgtcagcaagcttctgtcgcacctccgcgtactggtcatagagtttccaatactcctcgctacacagtctattagcctcggcgaaaatacgtgaactgagactgtcaaacctttgggtggactttgcttgcgcgagctgtgccgttaagacaagattttcagagtaggcttccagacgtgagcccagcttaaaacattcattgtcagcaccacggttttgctctcctaattggtatcctcttactgaattgctcgtcttcagcctctctatttccttcttcagttcttcgttctccgctctcctatgatcggttagctcatgcgcaaaaactccaggagtgcatactgacaattgtgcctctctggcgccgatgtcttcaaaatccttctgcaaagttccctgcagtctgggcgttgtcgtaccgggcgtaagtgatgggcttccgggagaaccttcgagttcacgaattcgttctcgcagttcactaattaaagcctcatcccgttcacgctgctcttccgcactctgaagacgctctgtgagggcatggttgttgaattccaactgtttcttgaggttctgaatctcatgacggtcttgttcgatccgcggaagcactcgcctgtattcctccagctcaacatcacgttcagatgaccgtcgtgcattcgaatccgcctccttaagctgctgctggaggtccctgacctgattcttgagagcctggttctccttctcgaaatcctgaatggcttgcagtttttgacggtatttctctgccgcgttcgccttacgactcaactggtctctctcgtttttcaactcgtcatagtcgtcttgtagtttctggaatctctgattcttaacacgcatagactctagcgacattcggagactgtcgatctcgtcctgagcagcggcgagctttgcctcttgactcgcaatcagttcgtcctgctggcgtgccttactctcaagggcctttgtgctgatgcccacttctccttttccagattttaaggtcacaagacgatcctcagtcgaggccaggcggctctgcaacgtatcattgttctcctgcagccgtgctagacggttgtgcatatcttccagagccttttctaattccttcttctcgcttgccaaacggtcattctcggcgagaagcttccctactcgctcctcaaactgcagttcggggtcgacagtaagatcccgtttggagatcccatctctttcctcctcttccgccgtcaactcatcatgttggccgttctgagcctcctgaatgatatccttcaagccttcctgtgttggggtactcagctcctggagtgtggtcacgtaggcctccgcattgggggaactgatcgcggcgatcagaagcagcttcaggagcttattggtctccttgagtgaattggcctctgcaactgccttcaggtcaggagatgcgtccagccccgggggtaattggtcatcgttctgtttccgaatgtagctgatcagcaacttgtggaggtgcttcaagttctgccatttggtgacccagtgatcagaagggttgcgttccggtagctcatcgaggaaatgctgcgggtcaatatcctgtaagatctcccacagaataatgccatctgtcagttcatcggtgctccggatggtcttgcccagagaaaagctgttgatccactcgagcaagaccttggcgacggtgtgttcggtagccatggcgcgagaaataggggaaaggccagtaagaatggccgatcgaaagatgtgatcaagcgactgctaggttcaacaagagaagtcttcgcatgttggcaaggacaaagtgggggattatgtacagttgtagtcgtccgatctaactagtcgcgacttaggagtgtcaagaggcccgcggatccacgcgtagcgcacattgttctccgtccagggaccgatgtcgttggcctcggtcgcattgtcacttatcagatccgtgcggacaatcaattacgcgataacaccgccaaggccaaagaaagcaaaaaaaaaaagacaaaggatttacgatagcgatttcattgtcttgcagcaaaaatatccataatgaacgagtggaaaactatctaaacattgctacccggtaccaaagacgccaccaaggagaacaccactagaccataggtaatttccataaaccaagcccccgtccagaaccctgaccttttaatcgtgaccatcttaattcttttccatttatattgggattccattatgtcaggtattcccccgacaagcagaccgtgctgcggaccattcaaatgcaatgccggcgagtttagaactcattttcttcgccaacgaaactgccatcgacagagaccatcttatcctcctcaatgacgggattgaatgcagcggacaatgtcgatacactcttgatggcattggcagaagcctttgccgcgaatcctctggttgcctgcgtcagtgacgtcgttcagtagttgggagagaaggggtcgataatacttgatcagatctaggggaaaagaaatgtcagtaaagaagtgagtaaccaattgaaggaagctgggacttacggtattcatgggtgataatgccaccctattgtagaagcaggtcagcgatagtaacaagatgggaaaagtggatattcagcatacggcatctttgatagcttgctttgcctggcccagaaccgagtctggcgtatcttgaggataagtgacaacgaaagacttatgtggctggacggcaagggccacttggacgaggctgcataggaaaacaacgaggaagagcttcatattcatcttgctggtaggagcgtgctggcacttaaaacaatagtactaggttggttaacaaatcgtgcggagtcactgaagggcgattgcacacactgtattaatgattcgagatacttgccagttcagatataggctctttgcaaggtctccagctggaggatcgtagggtgatgagttgggttgctggggattgtctcgccggctgcgattcgccgccgagcgtcacttgcgtcactcgggatgcgggacaacccccggctccctataggttgtactgcttgctgactcagcagtcaagccgtgaatcgacgacggcctagggaaagctaaataataattcgctcctctcactcttgctgctctttcttccgtccacgccccccatcccgactgcctccacgctcctctttgtgcttgcacagctttcatctccttgatcctttctcattctagatttgctgttaattccttgtttcggttttgcttttcgactcgttccagttcagcgttgcctcgttcggttgctattgggtgtaccccttcctttcttgcttgtccgccgcttcgacttcatttgtcgttcttcgtatttctgctgctctttctctgcaaggaggctactgaggcaggattctggaggcggatacggagctattggtggcttcaggttctcttttcacacgggttggaggtgttcgcatgacctgttgttctcagtctcacgaagatagctagcaagcattctacaagtttcgcctgttcattccacattctgcacttccaagagatcatttgaaaaacacaaaggaaggacaaggaatcagaagacattcgttccccagattggaacttccagaggatatcaaaaaaaggaatctggttaaaaaaagggaagagaaaaaaaaggaagagagaaaaaaaagtaacaagaagatactggagaggaaaaaaataaaagaaagagaacaaaggagaagaaaaaaaaggcaaacacagacaaatcaaactcaatcgtccttgaatcaaggagaaggcatcgcctttctcccgcgggtacttgtcaccgtcaatcttttctccaaacttcctgaccgtgaatctctgaccctctatacctgactcacctttgtataaccctacatcatgtcgtcgagccttccatccgatgaagttgctgaggactacaagaattcgcttgaagatctaaccaccaatgacaaattccagatcagcaatttgacggtcatagccaaggaaaacacagaacatgctatggctatttcacgagttctggagaaccatattaatactgtaggtgcctctctccctctcctttccgctgtctgctgtcgatgtcttctgctgccccctggttctgctctatccttgcttttgacctctctgaatcgattgattttgtcctgtactccaggccctgtgttttcgtagtgttatttttggggcgaagcgattctaattgtggctttgtagacatcaccgtcacagaaactgcctgctctctatgtagtcgactcgattgtgaagaatgtagggactccctacactctattcctgggtcgcaatctttaccagacatttatgaatgcgtacacactggtcgacgcgccgacacgcaagaagctagatgagatgctcaagacgtggaaggaacccgttcccgggtcattggatcccaggcccgtgttccctgttgaaatcacacgcagtatcgagaatgctctgatcaaggcaagaacagcagcccttcagcagcaacaggcaagaagtcaacagcaacaggatgtgctcgggcgaaaccgtggtgttgcaacgcctccaggttggacacatactcccactccgccgcgatatccgccttcgtctggcccgaattatcctccccagtatggggccaacggccatcatcaagcctattcgtctgctgtgagtacagatttttcctgttcgctttcccagaagactgttctaatgttctgtcaggccgaatcgtacccccctagatattcgcaaacgcctcagcaattctcttcttccacgcctcagtctggtcaggaggttgacctgggtgccctgcatcgcgacatagaaagcctcatatcaaccgctcgaaccgactttgctaataaccctcttgacgttgctgttcagcaacgtcttaaagctcttctggatctccagggaatccttcagcgtcaggagcttccccaggaccaactcaaacttgtgcgagaccaggtgtccgccctggcaccggcgtcaagaccagtttctcagcctccatcgaatttccctcaaaatctctctgctgtcccaactaccgcaggtcaccctcaagctatacccactccccctacccaggcaattccgcaacagactccgcagccaaacttacagcaattattaaatcctggaacactcgcagaactgatcaaggcgacagcgaaccgtcagcagcctactccacctccggctgctaatattcaccctcaagtccaacagaccagcactccgcaaccttctgctgcaaccccggcaactccagaaagtactcttatcgcaaatcttagagctcggggacttcttccacctgttacctccacgccaccagcctcctctccttttaaccttcccctcatcgtgcctggtcaaattcgatatacgcctcctgtttcaaatccccaagtctcaactacgccagatatcacgatcaacgtgcagatgagcactgcatctatcaaaatgtaaggattattttgccttttataccccttgtccgtgccagtcgctgactctggataaaattggtagccctcgtcccactctcataactcatctttacgaagcaaagaccaacaagtgtggtacctgtggtcgccgtttctttgccaatgaagaggggaagcaaaagaaagcacgccaccttgattggcatttcagaacaaatcagcgaatggccgaggctgctaagcgcggacagaaccgcagctggtacgtggatgaaagggtcagtattagtgatatctcctttgtccgttggcatgccgagcgcatgcgctgacaggtagctaggattggattaaatcacgagaatacgatgacgatactggccctgcgggtactgtaaccggcagtacaggtgcagcggccgatagcgaagcggctaaaaagaaaccgcagaagcagtggatccgtgctcctaacgatgttgggttgcggaatgctccctgtccgatttgtcaagagaagtttgagtccacatggtcagaagaggttcaggattggatctggcaggacgctgtcaaggttggtaatcgagtgtaccatgccagctgctatgccgaagtcaccaaagatggcccggcttcaggacggggagggacgccttctggacggacaggaactcctgattcagtgctgggaaagcgcaaggcagaggtgggtttatactttcgctagctagtagtaattggggatttactgactctttcttctcttaggataccgattctcccggtcataaggttcgaatcaagacggaacctgtatcgtgatttcgcttacgtgtccctgttgatatccctccattcttcattgtattttccctccctactcatggatttcttcaacattctgttgaataggcggcgggagtttccatgcgcaatctttgtttgagctgggctctgtcatggattaatgactgtacaaggcatagttttgcgcgtgtgttctgagcatctttattccagtcatcatgcatttacaggcgtgtttcacttgaaaagaggagtttcttacatggcggtcctatcttgtcttttttttctccatcttttcctgtctaccacttacttgcatttagttcgtgccaaagccaaaacaaggacggaaagttcatggcccggcccggaacagagaattacctggtagcaccattccccgggaaaaagatcaggcttaaatgtgatcaaattgaccactcacaactattccatagtcctagtgtgacacggatgtaacgcagctgatatctgtgaagcccttccaatccccaggattaataaatataatctataggacaaaggtgtgtccaaacccaagcaaggatgacaaaggtgggtcaaaattaattcgggaaacttgccgttccctcggacgatgatacgtcatgcccgttccacggaaaccctggaagcaattcgagatttgcctaaaatggagggggatacccctctcccggatgtcctccaggccttcaaaactttaaaaagggcggggaggtgggcgggtaggtgggatattgtgaagctacctatttacctaattggaacaacaagctctcttttttctttatcttctttttccttctctgctccgtgcaccgccaggacaattgttagaagtacatacatactgtacagtacatacacccatccatacgtatccaatccaagaatcgacgacgcgtcccacaagtaaaactcaatcgattgcccccttttataaattaagcaaagaccaaaaaagaaagcaaatatggcgagcccgttcaacgcacggtggggtattctgggtatgtatatcgaggatgcaaacttgttatatccccccctccattgagtaagagccttgacagaggaaataatttaagctaacgttttccaattacagctactggtgggattgctgcaagtacgttatgttcttgacctcttacttcatgctatgagaaaaagagggaaaataataacaatcgcgaaccaccagccttcgtaaaggatctcttgaaaaaccccaaactacgagggaccaacgatgtcactcatacggtgactgccgtcgcctcgtcttcatccaaggcccgggcggagcagttcatcgctgagaccaagatccccgggccttgcgccgcatacggctcgtacgcggagctcgtcaaggaccccaatgtcgacatcatctatgtagccacgccgcactcgcaccactaccagaacacaatgctcgcgctggaggcaggcaagcatgtcctctgcgagaaggccttcaccgtcaacgcagcgcaggcgaagatcctgtgcgaaacggccaagaagaagaacctgttcttgatggaagccgtctggacccggtacttccctctcagcatcaaggtccgggaattgatccagaagggcgaaattggcgaagtgctgcgcgttatcgccgataacagctttggcgaggatgtcgaaacggtctgggggacacaacaccgcatggtgaacaaggatctggctggaggtgcactgctcgactgtcagtaatcccagatccttcatttttgcactggcaagaggatagttagactaacagacacagtgggtatctactctctcacctgggtcttccagactctctaccacactcttccccggtcccagcgcaagcctccatccgccattgcgacacacatgaccccgtaccacctcacaggcgccgacgaggcgaccacgatgctcatcaccttccccacgaccactccgtccaacctgcctaatcagacctcgcacgccgtcgccatgacgcacctccgcatcgcgacggatccggacaagaacaactccacccggcccgcgattcgtattcagggtaccaagggtgaaatccaggtcgatggaccggcattccgtcctgtgagattccgagtgattccccgcaaggatgagaatgccaccgagcctgtgaccatccgcgaggagaccttccccttccctgacaacggccatggtatgtactgggaggcagacgaggcggcacggtgcgtgcgggatggcaagctcgaaagcgagacactgccctgggaggagagcatcctcatcatggaggtcatggatgaggtccgcagacagggtggattaacctaccctgagaagattgagtcgaccgtctaccctctgcagctgtaaattaggacatgctcccaatgggtcggaggagacctgtcccaggctgagcgagacaaattaaattgtagatatagcatagcatagcgacaagatacagaagacaacgtttttgggaaaccgctaaatgcgacggccaaggggtcggtagtatctcccaacccattcgcgtgtcctcgaatgtcggctgtctggccttgttgagacatttcagtaatacatattcaataaaataaaaacgggaaaaaaaaaactcgcatctgagagtttgacataaggtaagctccattgtgcgtcagcctcacacagcggttacaatgtgtctgcacatcgtggcatgagaagtgaaagttttgaaatacggaacttttttttttcaaaaaaaaacccccagccattcaggagcttatagtgtgaaataagagatttctgacgtgcaacggagaatgtacaggtttacttcatatgtacgtaagttggtttgcttcgtttgtgttgtactctagacctaagtctagagtcatgtgccaatggccatggaacaacaggtcttattgaacagaatcagaaataaaattctcttttctcacgcttcctatctagatgcgttagtaatgctcacagaacctgattgaattgggacgagaagttcatgttcaagctgacaattgcaaggtgtgaatctaaaatctacaggtcatcaaaacgtcaatcagatgagattgcatttgatataccatcatcaatgcagaaaagtacagtacatactatacaggagcaaacagttcccgcagcagtcctatgtgcgagtacagtttgctcacgccttctcctttcacctgcagtctgccaccaaagcaaatgccgagacaaaaaaaggaatatgataacttttccgcatgagatggtcatgagcgcatccatcacgctcaagtgaggtatatttctcaagcttctatccattgttcccaacccaactgtggattgcttcaaaattttttccccttgctcttctaacccagccagtaagaagaaagcgaaatcgaaatatagcaacagacctgttgcagcagaggttttacttcgacttctcaaaaacaccgaggagactcttccacacctgaccgggttcctggctcgcgtcaatgccacgccagattccagtcttcttgtagtattcaaccacaggggctgtctgtgcgtggtacgtggccagtcgcttcttgagggtctccgcattgtcatcagaccgctggatcaaaggctcgccggtcacgtcatccttcatgtcctccttgggagggttgaagatcctgtggtacgaacgtcccgaggccgggtggatcagacgacccgttatccgggcgaccagcagcgcatcatcgatctgcaactcgatggcatggtgcaacttctgttggcggctagcaagcatttcatccaaacgctccgcctgagcgacggtgcgagggaagccatccaggatgaacctgtgcgattgctgtcagcgccacaccagagtcacccataggaccattcattacccgttctggcattccttgttcgtctcgagctcattcttgatcatgttgaccatgatctcatcactgaccagcccaccctgatccataatcttcttggcctccagcccgagcggggtcttctttgcgacctgggatcgcagcatgtctccggtggcctggcaaagagagcaaaccggtcaattgaaacgcatccaaccgaactcctcaagcgcaagcgcaggtgagcttaccaggtggcaaatgcaatacttctccttgatcttaggagcttgcgttcccttgcctgtttcaatgcgtaagaccatgtcaatccctaaacttgtctatggtcacagagactcacctgcgccaggaggacccatcaggacgagccgcatctgctctgagagtgacttcggcttggagtcactgccgccattggccagacgctcttccaattgcgcgacacgcgattcgagcttggagatgacgtccttgagaccgtcgacggtctcctgcgtgatgggagccatttggggctacagagaaggaattggatgctctccgaggacaggacacgggaaggcgcaagggagaagaaggtgagctggagaggctgacgagtcgagctcgggaatggagagtgaggaggtaggagaggaacaagcaggttttagaggccgagcgcgaaaacagggcgggcggagcgagagagatcggaggtaagctccgcgtgtccgaggctcactctgccttccggaaaggacagactaagtaaagttaggctcttagttaagtagaagtgcccactgctcactgtccgccgtccaagccgctgggccgatctcatcgggggagctccagaaaccccccgccctggctactagcgatcgcggagagacgtccacaacaatgacgtgaagtgatatcaagcagtctattgcataaaatcaaaaattataatcattctgccttccacaagtatttctgtgaattattatgccaaaaatagccgtaaaggctgatcgaacgatttactatgtgacacgtgacttcatgcgccacattcattgctgcctcaggcaataaggcgtgacaatctgtggctgatgctgacggcagccatgcagttgctcccgtacaggaaggccgtacagcaagcaagcagcctagaagcgccggagctcccagccataccaccgttcccggcctgccttaagtgctggattagcacttcctcattgaccctccgtttcagtattcgtcttttactgtttgcctccaagtactcccttttgtttttcctgttctctccgccatgcctgccaccacggcggagacgctgtccctcgtgacgcgcaccgtctctattgcgcctctcgtcctcctctccgttgcagaccactacgggcgaactgcaaaggggacgcgaaaacgagttgttggtgttcttctcggtcaaaatgatggcaaaaatgtccgggtgtcgaacagtttcgcaggtgtgtacaagccgctgtccgctgccgtgatctagtggttactgaccaggagatcagtgcccttcgaagaagacgagaaagacccgtccgtttggtttttggatcacaactttgtcgaatccatgaatgatatgttcaagaagatcaacgctcgggagaaactaataggatggtaccactcggggccgaagctgcgggcctcagacctcgaaatcaatgagctcttcaagcgctacacccccaacccattactggtaattatcgacgtgcaaccaaaggaggttggcgtcccgaccgacgcatactttgcggtggaagagatcaaagatgtgagtgactctgccgttgcctttgggtcacgaatgacgaagggcgcggggtcagaagtagccaaggcttacatacagcacaggatggcacaacaacgaccaagaccttcgttcatacaccgtcaataatcgaggcggaagaggcagaggaaatcggtgtggaacacctgctgcgcgacatcagggatgtggctgtaggaacgttgtccacccgcataacctcccaacttcagtcattacaaggtctccatctccgattgcgagacatcggccagtacctccagaaggtcatcgaccacgagctacccatcaaccatgccattctggggaaccttcaggatgtcttcaacctccttccgaatttgtcaactccgtcagcgaacggtggggagtcatccatcgagaacagcgagctagtccgggcgatgagtgtcaagacgaatgaccaactcatggccatctatctcagcagtctgatccgtgcgatcacggcattccatgacttgattgagaacaaaattcagaaccgccagcagcaggaagagaaggaagggaagaaagaggaagaagctgccaagagtgataaagagggcaagaaacagaatggcaccgccaatggcgagcagaaggaagagaaagatagcaacaaagagaagagcaagaaaaagggatcatgatggacgatagatagacatgataatcgatctgagcaccgtctagagaggggcatgcttattacagaaatgtaattctatacaaaaaaaatcttggggagacgatgttcgtcctttcaaaacaatgatcatctaggtattggcaacatgggactaatttatttatcctaattcgtaaacgacatatgctagaatttaaaaagtgtccaacggaaagaggatgaatgcttttccctgtatatcgacctattaataattctagtagttgatgcaatgatattgtatggagtagttgtatatacacagtccgtccatgacttggcgtctgacggcgccttctatctgtctgcatgcatgcatacttttctcaattgatagtctaaagaatctgttcattcttgtcaaaaaatatccccataaagattcatggctatcggcacttggtcgaaaatcaccgatcttttttgtgcgaaaggagggctcgttttctctcactgagtcctccccagggaccttttattgaacatgcatgtgcaggaatttctctgaacaatacatctgtggaaggtgtggatataaggacttgcccgtgtgccagaatttccaggtcctggctcgatggtacgttgcctgtttcgaaacgctttccttcattttgaagcaagggaaagcctcaaccaaagggaattcgataccgtcaaacaagcaagtgggtggttgagacaaatacgtgtttacttttcaaacgtaggcctttcaaacgctcaggtaggattgcaatcatccagcccacccagcacaccatcctgctagttccgtcggtgtaacgatggacgtttcttctatcccattcccaaagagagaagggcaacgcgcccccaacacgcaggctagaaggtgcttacataccggcggggaagatctcgaagggtcacgagtcaatgtgcctccgaaccaacacgtttcatcgtttggtagtagataggacgcagtgtcttcctccctcgctgatggtgaggccgcttctgcgacatgggtctcgagatctcgaaatgcggagagcgcaaatgcagggcaagtgcaattccacgaacgaagacggacttcataggtctttggaggccctcctcgcgtcgacggttggaacatagagcgaacaaagtagatttcttcttcgtcggcttgtccaggcgagaatgccgaattaatctgttgtgcgtttccacgcggtgaagcttctcgctcttcttcttcttctactgtaccagcagcactagcaagctccaattcctctctgacaatgaaccgtttcacgagtcgccggtccaagatatcgagagcgagtaacagctcattgggaaagaggcagtgaagagtgagcatgagagacttcactcttgataaatcagatgcaggaagtcttgacagtgtattcttcgccctctcgtgctcttgattccgagaaagcagagctcccgtatgatgggcaggtccatcctttgttgttgggttctcgaaagacgccaactgggttatcagactggtcaagaaacgggaagtgcacggtattaaaggaggacgtgcatcatcagtgtccatctcagtatggatactatcatatgcgtttgaaatgttttgaatgttgtagtttaatccggtttcatcctttgattaattggtcatcgttgggagttgaatgcttgaatggatgcaaagggttattggttgatgaatggcttctccattaggcgggaagaaatccgccaatctgcaaataaaataaagatccccgtcaaccatatactactctctacggcatagttgaattagatttctcactaactgtataactgacattttaagcacttcctcttccagattgattctgcacaaaacatcagtaagcatgcctgttatctcaatttctgtttctcgctgttgtccggcctcgctgtcgtgatcttccccgagatgttgtcttggccctttttgccgcagttgacgcttgatctccggtttcttgttgttcagggtccctcttcctcttcctagaggcagctggtttactcctagatattgatttctcggttgcttgcctggtttcttgtgactcatctctactttcgggttgctcgggggtctttttcctcttcttcgatgttgctgattgactggttcctgacgcggtttgtcgtgtcttcctccctggtttcttcgaagttgtgtcttgttcttgaacgaccttttcttttggcttcacgttccctttgagagttccctcgagaacgacgtcggaatcaccctcacggagtgtgatcaagagcacgactggctgggctttggacctagtcctcacctgcttcacaagagggccgaattcggaacgtagaggaagttgttgcctaatgcgaccttcaagatctctctcattgatcttgatcgtaccttcgagccagactggtgttccattgactgatcccacaggatcttgcgcattttcacctgaagattgcaattctccttggcgatgatactgctcatatcccgatgccagctcgtatccagacgcctgttcatatgctggcgccaggttgtccaatggcactggctctttttggagtgtatgctgacttgtctttctatatgcgaaaatataagatgtcgtaagttcgtcttgtagctcctcaatcccttcctcggaaatgtgctgccgactttcgtcatcgaataacatccatccgccaaccggtcccttgacaacagcaacgtaatgcccactatcgctgtctccgatgtggaataaaacaccgtacagttcataggaagtacattgattcgggccgttacctccagacgctttcccgtaccaagactctatgtcgatacccatttggattttaataggcgtcgtcactttgccattgacaccatgtctgttgacgttgatgaaaagaatgtctggtgtctcaagaattggagaccactcgaacatgtctttgtcctttttgcaattgcggcatggctttccagaaagctgctgcggccgcatgtagctgttgataacagtgtccatcgggcacatgggaatgccccgtttcttcctctccttgttgttgactccatcgtcagagacttgcccgcccaggaacagtaagtcatccggcttggaagaagactcgaccgattgacaggcttcacaggcgtaatgtctctccactaccgaagtaaacacagggaggataggtttgccacctctgatgataatgagtcgctgatcaactagtccccattcctatcaagagaatatttggaagatctcttacctacgtgtcgcctcctgctgaaagctttgcagcacgcactccatgtattctcgtacatcctgctgctcaccttcctgccagtcccctggcgccgtgaaatcccaaagcatccccacgtaacccctaaaggctgcatcgtcttgtctaacatcggcgtcaggggaccaaaagatctctgctagtcgatgaaacaggcagattacgcatggtatatcttgatgggatgggtcgggatcgcagaagtttgcaacaaagtctgctgcccagttcaacaggcaaggcgtatggaagaataacaccaaggccgcatttcggtagcaagcctcttcagcattattctgtagtcctttcgggaatgtgtttctggtcgatgaatccttccactcggtctcgattgcgctctgctgcaattagtactctattaaagtgacttcctagtctccctggaacaatctcctcggagtaagagcatgtatatttctccttacctggaggtatgggtcagccgtccctgaagacatttctacgcttcaatccaggtgctataaagcgaaaattggagacgctcaaacaaaggctgttgtcgatccaatagatccgttgaggacatgtagcttgagggccgtcccatcgttgctcgctctcttcatggagaaaatgagacatttatgtccatcctggagcagcaatgcttgtgtggcgtttctttgtgcttcgttattctttctcatgacttctattcatagcagggaaaaggttccttgactggatgctcatcgtcctccaatgcttgatttcaacatcccagtcaaatctgacgaacactcttctgtgaaaagaacataaagaacacctctttttcaagtgggaagaaagaagaagagaacaagaaaggatcggtcctaaatttggggcgggacatttctttgtctcgtcgaccttttcaaacgggttgtaaaaggagagaggtctcacaggagttcggtgaaggtggtccatgttctctgttttgttcgaagggcgagtgagtctgctgtttcgttatcttgagcaattggaagtcaagaggatgaatggatatcgatgtctgagatcatgtgtaaagcatctttttgactatattggtatcataaattataccatcttttatgaaacctcactccaaatagggacatggacgccacgagttctgcagccctacgaagtaaggaatccaacacctgcatgtcatcacttgcatatggcaaagacaagcattatctcaatcctatttaaagccaggtccccttggacagagccatcctattggagtcggtcgcctttgtcatggagacttcagctggcgtgacaagggactgcttgcataatttccaggaatagaagtagtcagtcttgacaaagataatgagtcaattactccgtatataaatcgactaggttagtagtatacccaccccttggtggatcatagacacaggtagcgatagtcaacgcgggttggccatgctgctttcactatagtaagtacagcgcaagggacaggacagttgcttgactgaatatgtaaaaattacaacccatctgggtaatgtctgttcagcatcgcatcagcggtacacgtacctcggcaacgcagctggatgcgggacacgtgccgcatcggcatgtcattcgcttcttgcccctgtcgcggagtcgctgcagcatcctgagcctggactacaaccagcatcaggagtgctcgactcctgagttttttctttgtctctatgctttgcgcctggccagtgtcgtcatttatcttttcacttatgttatgcacggcactgcccttttaaaatggagtcgcatcggcacgccctcaaacagataaatgcggcgttgctgcaaccatcgaagtggttggcatcttacgaggatctggtcacgaaaaatgtcaatactgtgggccagatagaatctgctctgagatccttgacatatatcctcactggtgggtattctggtttccccgctcgtctcggccttgaaactgatgtatgttactctccaggccgttatcgcgaaaccgaccttccttcagaatgcggtaagattgtgagtcccagacgtcgcaaaagattagcgcgctgatatgccgtgcagtccattctggagtgcaacttctctctctgtatcatgactcgcttgtttcgcgggccatcgctcgacttccaccatctgtacctcgtcctaacccaactccgcatgcccgctatacgaagtactggacgtctcgttctcctctctaccacaaggtcgcgctcactctgcagatgattcagtatactgagttgctctgggagatgattgcgcgacggcgtggagagaaagtccgctggcgggtcgttgttatcatcgaaatcgtcaaggccctctgccgcttgatgctactccgattgaccaactcaagaccccttgtcagtcctccacttcccgaacgcgaggaagacccaagggcagcggaagcagaccaggatactggtgattggaatgggatggatacgccaccaagcgaagggtcttctgagttaagctggacgatgcctcggacgggtctttcacttccgagtcttcctgacgcaagcgacatttccaattatctcatctccaaagtcctgacagcagacgacgtcaaacctccaaaggcgttgttacatcgcgttactgggcagggccaacttgcggaaatactgtatatactccgccctgttgtatatgctctcgcaatgcaaaagtggtccggaaacaagcgaagctggagtccttggctgatcggctttgccctggagtacggaagccggcaactcgccaagaaggacttcaaggaacgagtcgccggagggctgcgcgggctcacgggtctggagagagaagagcttcggaagcgaggctgggcaatgggatggtggctgatgaggggtgccttctacgaaaacatcacaaagtatgtcgatctacaccgttgctgtttgtgaacttgcggaaactgacacataatagattgtggatcaaaggcgccgcagagaagatgaagggcaaacctctattagatatcgtgggaggattacttgaagattacgagtatctctgggacaactactatttcccgaccgccactctttgatgaaagtttcctactgtttcttggaaagcacaatgtgatcctgctgcgtggactgctagacagttcgcatgtataactatggagttaccgggatatgttttatcagttgaacaggctgcttggaaatactgcagggtttgagaggtcggaagaaggcaaatcggaattggaaattggagttatgggtatcactcgttatcgtacatttcaccaaactaatgcatagtactttttcctaattcctcaaaaagcggttcccaccttgtttccataccaattacacaattcatcatttttcccagtctcgttagaaccatggctcaaaacgaaatctgtgagtcgcgtcgtgtcgtcgtcgtctgcaggccattccacctttgtcgcttcctttccctccagcatctcttttgcagtaccccagctaaatcggcattcattgccccaaccaaatatggaatgcatctctctccgcagccagccaacacacttggagtcagacggatatccgctgccccagccgtcagctggtgtttgcgtttcttgcgaggcctcctgtcgatctcgctgaagagcctcgtagcatacatctagcgcagcatctctagtcaccttcgcgacaacactggctgcactgacacatggatatagtgcgtcagccttcttcgcgacagtgatctttagagacgggaagatccgctccagcttctgctgataggatgccggatttccgactgtgtctatatagacctctctcacatcaacatgtctctcttctataatgccacggatgatctcaattgtagcatccatcgcttgcgcgttcaagttgtaagcccctacgccaggacgcatcatgccggaagaaatatcacgggcagaaagaaccttgactgcccacccgcaggaattgtgaagcggatggtcacttgtgcataggagacgcatcagattcgagcgcacaccgggcgtgagggctttgctgtcgttgaaactatgatcacgagtaaggagcgaatgttctaagtctttggggaggtaaaaggcactgtagaccatgggccccagaacgggaccgcgcccagcctcatcaacgcccaaaacacatggtgttgaatcagcagcttcatcagacagggaggtcgatgtgctagccagcttcagtgtactcggacaaggggaatagtgggtgtaggagtctccggagagcaggcgcggcggatctatcgaaggcggtatgaagacgtcgcctggagtctgatcgggagtttcgggcgactcctgtaggatatcctcttccatgattcttttcctcgcatgtatgaaaataaatatgagttttagaataccaattgatttggacacggggcgtacaaggagtaatccgcataactgagcgaggatagcagcggcattcgacgcgtcggcacttttcgggtctagcgcagctcttgcgggcgtgggcgcgtctccgccgcatgggccggatgtatactggccgaccacctgcagtttagcatctcccctcacacacaagtcctccagcaggcatttcaggcatccctcttcaccctcatttcaagcctgttgttagcattgccgaagtcgtctataccgcgcatcctatacccaagtcggattgtcgcttgcagctgttgtcctgttgttgccacacatctaggttttcgaatttggccatggctcctcgggggcctgtaaaagctcgcgaatatgactattctaacgttggcaaggccggtaggtgagtatacttttctttttctgtggatatcgaattgggatggggattttctccttatccagaatttgcgcggacgctgacaacggggttcaggcgtaccggtattacgctgaaagagggcaaacgcgatgagcacgggatggaagagatagatgggatgttttcatcgccggagaaatcccctgtcaggcctaacggtttcaacaatggcaacgagacgataatgggttccgagggcatgtccatggatgaaggtacgtcttgcgccgaccggtttctagcgatatcctacacgtttgtgttgcgttgtgttttatcagaatcgcactgtgctcatacaaatcatgagttctaggaaacgctcctggacctgccgatttcctttctcggtccaatggtcagcgggggtcatattttcctcctcctgtcgcgcgatcacctatgaaaaccggcctcaccggttcacctcgaagaacaccaggcgtgcgatcgtcaccagtggttcagagtgatcaaacttcccccagtccgtcctctgtgcgccagcggaacaacaaggaatccacgcgatctgatcgccgtcctctgaacgaccgtcgaccgaacacagctcccgtcacgaatggtgtacgaggcaagggtaaagaaaaggagtcggcagttgaaccagaagctaccgcagacttttcagacaatgaaaacaatctggtgtacggagacgaaaatctaggcgatcaaacacatgacgatttgactgctggtgagaatggagatcaatatggcgacgatacagccgaatatactacccgcacggaagacgttggggctcaagatgcttcagaggaagcatcaccatcagttgtagcagctgatacacgaaaatctcaccaaaagaagtctgctgcagatgtcgatgggaagcgtgcctcacagaaagtcgccgatgacacgcaaaacaatgcgccaaagcggaagcgtccgggacggcctccgaaagcgcaagcacaggctaatgtagacgaggagccacttgaccgacgaccttcgaagaaagcgaagtcctctagagctgataccgggaattcgacgacacagttgaatccggaattggaaaaagttgttgagaattatgccaaacgtacgggtcctctcaaaggtcgcagcttatacattctcaaacgtgaaacgccatcggatgaaaaagtggtgcacacccggtctggaagagtatcagtgagacctctggcatattggcgcaatgagcgatgtgtctatggcgacggcgaggcagaagttggagagcgatttcctctatccaccatcaaggaaatcatccgaacggaagagctgccgcctgagaagaggaggacagggaaacgtaaaacgtctagtaaaaagtcgaaaacaaggagaagcaaagatgacgaatcggaggatgaggaggaagaccacgcggacccctgggaaaccgaaggtggagtcctccacgggtacatcaggaaatggaatccggagactcagacggctacagatgaggaggaagtgctgggtacgttccctcaagacatagtctgcccttgcaacactgacatgaaagtgtagacattgcctatgccccagcaggcattgaaacccgagatgttaaggactcgactttccgctttgcaaagctgctcagttctcctttcatcggatcggggattgtcgaaattccccctggcggggtcaagaagccgaagaattccaagcgaatgcacatggtcttttatgtctgccacggccgagtgcaggtcgatatatcaggtgtccaattcagcgccgggaaaggatgtgtcttccaggttcccagaggtaatatacccttccgatctactgaaatatccagaggaggagacactaacacaaatctcaatcacaggaaattactatagttttgcgaatgcctatcaaagcgatgcacgattgttcttcacgcaggggtgtgttccaactgaggcagaaaaggcggaaaaggccgataattctgcgagtacggcctccaaacctgctgcttctgaacaggaatcctctgccgaaaagtctcagacgaaaggcaaggggcgaggcaaatccaaggcctctgagaacaagcgataaaaagggggatagatattgttcctttcacttcatgcctatcgaatgagttttactataatcctgttgtttgcgacgcctttgaatctgtttaatattattgcgcatatttagccggctttttcaggagcacttgatgacggagtttcttggtttctttctttccgatgggttggggtggaatcttggcgtctcaaggttctgcttgttggatgatactcgaagactggcattccccgagctcaccaaacttgcctttatgtcttaaacgacaggtatctcctgtattacggtagtgttatcgatcagcgttggatatattctcatacgtcgggatagtcggtgtcatcttattgaccttcgcatgttagtttgtggtcttagccaatcttcaatttggtttaaacagaacagcttatccttgggtaagatgtcctggattttttcagagccttcgtattgtcgatgaataactgagtttggaaaagatacgtctggatggtatcaaggattcacctcccaaatccagagccgagacaatagtccacgccatgttcgatagtctcaagttatatatagagacttggaagtcacaacgtgaatgcaaccctgaacgaagctggaaagcatccaggtgaccagatatatagcatactatatttatatcacatctgtcatctggtagaattggaaagttgtgtcctgtcgacctgtccagtatccatccatgtgggactgctgcaggttagataatagttggacctggttcggggaagatcagcgcttgtgagttatttttttctcttgtggagtgagctcgagcctcgcttggatgttgttgttcacttaggaaggagtcactgtgcttggggccgttcttgggggtctttgggtgtcacgttaccctaacacgtgttcccgagtactctgtacatccgtttgttctcctgtggaacatgtcaaattatcgtgctgattgttatatttagtttagctatttacgtatatctggtcgcctgatccaacttctcagctgttaacaacgtgtcttggtcagagttgcatattatagatactactgtacttctactacgtacaggagttattttttttttttgaactttgtaggtaccggtatctgtttcactccacgcctgtcaattcctgcaaataggatttgtctggctgtcgggcacgagtggcagtggcacagacggagtggcttggttttatcgaaatgacgatctactccaattacatcatgcggttgcatggttctattgttagtatcgaagatccggccttgtctattggcgaggattcaggagtcggccactacgcgagtgcttggcgacgccgtttcgcgttcctctgacagccagccttcctgtaggctagctagctgctgctggcgaagtagtcctgtactgtagaactaggggatccttctagcattggataatgtattacttaaaaagtcaacctctcccctatgtgctgtgcttcttgtttttgtatttatatcactatcactacctccttctcaagaagagctcttgctgaacaaaccactcaattccacatccaaaaccatatcactgccggtcaacaagactcgacacttgaacttaaaaaaaaaagaagaaacaacaacagacaacatgcgcctggatcttctcctcgccggcctcgccgcctccatcgctcctctcgcagatgctcgtagcgtctaccacctctacggggcagcaggcaaagctccctggcaagtgacgaacttcgaagtcggctgctcgcccggcggctgcgcatacagcttcgtgatttcgggccgcgccgggcccaacacgccgggcttcaacaccacctgccagggcaccgatgtcgcgggcgactaccagccctgcgccgacaagacggtcagcgcgaacctgatcccgcgctcttacccggtctggaacctccaggtcaggcaccggtggaccgtggacaacttcggcggcttctccgaggaatacggcaatgccaacatcacggccggaacgaccaactttactgttccgatcacgatgcaggatggcgcgtcgtgagaagtcctgaatcaagagagagagagaacgaacattcgaaatcctcatatgatcgatcatcgttacatgccatgcttgctttttttctcaaagcatcccgagagataccattcatcttgcacggcgtcgacgggcgttgatttaatgtctactattgaatttttcttgcacatggaaccagaggtccatccttccttacattatatatacacttaatgtttatgaccgatgaccgatacataatcctgtacttagatggtgcatatgcttcaagtttggatatagatgcattgctgctacaagataccatcgtttgttaatcacattaaaaatatacaatgataacttagtcagttggatgccattcacattcgtcccagctagatcttagcttgtcaatcaactgggttggaactggtcgtccttggtatcacccgtctagaggttcttagacaacactaacgtcactcgtcttacttctatatctcctccatggcgtcatttaattcatcatccagatccagtggaggaaagtcgcccacttccaccttgtccggcttcacaaagacgcctcttttgtcgaggcattcaaagtaacgtttaccaccaatgctgccgtcatttttgcccgtgggctcatcgagctcgatgcctacccagatcgggagtggaccttcttgattatcaacctttcccttcaaccccggaaagggaatctcaggaaccggtccaacgtagcggatggttccgcggcgtacgtgtggcggtgacgatggtagaataatagcacgtgcggatacagttatgcctaacgatgtattaacgtctggctttaagtagctactgcagtcattttcatttctcacctctcttttggacctcttcctgatccttggccgcctgtgcttgcatcagctgttccggcgtctgggcattggggtcgaaacgaccgagtttattggcctttttccaggcgagaacggaattaggcagggcctcataggtctctgttggaagctcatacttctccaccgaggagaggtcggagaagtttggccttgcagacggcgggcgtgtatcatgaacctagctggtcagctgactttgccagagtatcttatttcgtccagtagagacggagagaacttgatcttgggaaggcaattcatttcgattgggggaagtcataagagatgaataagcagcaataatgaaacaagcaaaagatgagagcgaaagatacccaattatgcaatcattcgtagacaagataaggccacagcaatatgtgaaaaattaaaactacgaaattggaaagacaagggatagtatactgatgggcaataacatacctctatttcacaacccctcgtcaaaccccactctccaacaagcctctcgtcaccttcaatccattggtcctgtttccccggggacttcaataacaatttctggttccccggaggaataccagtcatcgtctccaatttgcctttcaactgtgacacggtccatgacggcgtgacacgacgctcggtcgcgattgaaggaccgctctctgtcccagggccagatgaggccgtggagataatgacggagacgtccgttggtgttggttggaaggacatgattgactctcaagtggaaatattagataatattcgagagcggtgcagataaacttgatatatacgaaataacaaagagtaactgcacaagtcaagagcagaaaatgtcaaaaaaaattcaatcaaacaactgacgattggaagaacagagaatgataagaacaatcgaacaatcaaatttctcaaacaagatgtacagtacatcatacaaagctcctcggaatgaagactggacgagacggtacttacattagtaatagtggtagtagtaatgtatgtatgtatgtacgatctgaccacagagatggcacgatctcgttccggcaaaaatcactgatatgtacagtacaaaatgatagatcgtcgccttctcgcaacgtctctctcacccagtcatagacttgggcacaacaacaaccttgctgctgaaggctctttttgatagttttgttgcccaataggcgagatggcgcggcagaaagacgcttagtcatccggaattgtcctcgctcactcccggcagcaaaccagagaggagcaagccgtgcagccaatgtctgtccatcatcatcattaaatactgtcgcaaaaatccaaccatccaacaaataagaataataataatagcaaaaaagaaatcattgcaggctacatacatggaaccggctgaccagacatcacctgatttgaaggagagctccaaggacccctcagaggcatatgaggaaaaacacgtgcatgaggtgtaccagcagatcgccgagcacttttcctcgacacggtacaaggtatatacacatatatccatatccctagtttttttttcttgatttatggatccatactgagactgaacaaacacatcatacatagccctggccgatcgtggagcgttttctccagaatcaggaaccaggctccgttgggctagatgttggctgcggtaatggcaaatatctgcctgtaaatcctaacatcttcatcgtcgcgtccgacaggtaagtggctcattccggctgtatgtactttggtcggaatacatatcactttttttgggggagaggccacatggtatattcgaatattccatgtaatgggcaaggaaaatagtaacatgtatttatatacgcatgttctgattcttcaatggcaggtcggaggctctggcacggatcgctgtaaagcatcagccgcattcaaccatcgtggctgatatattgaatctaccgcatcccccttcgcttttcgactttgccatttccattgcagtggtccaccatctctcgaccccggacaggagagtccgcgctatacgcgaaattctccagacattgaagcctcccaccgaaacgagccaaggtggcaaggctttgatctacgtgtgggcgctcgagcaaaagaccagtcgcagaggctgggacaaaggcgaccagcaggacgtgatggtcccgtgggtcatgagaagcaataattctacttctgctactgctgggaaaggaacagatgatcgccaaaccacaaaaacatttcatcgctattaccatctctatgaagaaaatgagctcgaaaaagacatccgcaacgcaggcggcctgatcctggaatcggggtatgaaaaagacaactggtgggctgttgctgtgcgagcgccagacaacaaagacaacaagaagtaatagcggagtggttgcttcgaaaaatcaaacccttcaccgccggtcattacaaacatcgtaaagttgtgtgtgcaaacaggtatcaaatcgtgagagacgtgaccatgactccatctgcaaccaggcgattctcgcaaacttttctcgcacaatcatgactgtctacctcccaccgcgctatgcaagacaaaagaaaagaaaagacaggaaaaagcaatattaagagggctctagggaccggtctcctcccttacggccttgtgcgtgctaatgaacccggatctgcgccaggcagatcaccaggttgactgatgttcagcggcggaggaggccttgtcatccgataagggtcgacgatgggctgtgtcatcgtccgtgtgagtggcgatgaatatgctggcacccccgcagtgagttcttcaacagacggcagctgaggtggtgccggtcgctgtgatactgagggcctcctgagccgtggcatcactgtattacttcgacgagccttggatgcagactcccccgatccactggagagggaaaacggcacaacaccggctctgcgggccatctcttgctctcccaactgccagtgcatggcttccgcggcgcgccatggaatcgccatttcctcggcgactttggaccacatttcagccttgaacctagatgcgcaggcgtcagcaagacaagtttgggaatcatgcgctgcgtgagagatttccgtggagtttacctttcatacagtcgagccaacttgttctttcggtcttcgtcccattcgctccgacgctcgagatagttctggtagtgaagacggcaactgattgcgcttcgccccggcaaccgtttgctgatgtcctcccacttcatcccccttccgcgcagttcgatgatcaacgcgtcctcctcaggggaccattttgactgttttttggccggtggctcgttggaatgcgcgggttggaggcgttttgtcccggctgacgccgggagcgcaggcttagcaagagatgtggttgtcgtgggtgctggagccgagactgctgttgttgcaggcatggccgtggtcacgacgggtgccgtagaaggcctggaagaagatgcagcagataccgatggcgcttcttcctcatcgtcacgcttcagaagcagtgagatatccactttggcgggggatattgtattttgcggtggatgtatgaggatcatatgcgcgtcttcagagggggttggggttttgttctgcggtgctctgcaatgggaccaaaactgcgaggcacaacgcacagaatacttgtgcacaccaaatagaaaaattctcagaaattgtcgagagaaattggatgcagacgcaataaagcagatttgcaggcgatttaacagtggctgacgatgcctttgtggtgacacgagtcaataagccctgtggacgggtctggctgaaaggaaggtggctcagacggcgggttggctttagactgcgttaacctgaccgacgactcggtatttctggggatgccaatcgtatcaagccagggcttgagatccaaggctgccaagttaggtacgtagggtaggcagaggcgataaatgcgaccaggttagggcttggtcgagggcgatgcgccagctggctgtcagacacgtgcgtcaagatcgggcagtctcgtctgtctggggcgtgaattaaatgtggctgaccaggacttcaagccgattagacttcttggttgggcacaaaagcgagtgtctgtggcggagtcgaaacaaagctatatagatctgacagcggaagctagaggggggggtgtgtagaaagcgttagagacgagagagaaaataagatttagttgacgaaagaaaaagagaaaaaggaaaaagaaaaccagcttgtcatgcaatgataataaatagctaataataagaatactacctgggtacctaattaattacccacccgagcttgttccagatcgtgtttgtttttctgctctgacaaccacgaagcggcacgaactaatggaagtaccccatatgtactctgtacctaacggagtatccatctgtcaacctaatgtatgtaccttatggatcttagcttaggtggattcgctaactatctacctaacctacctagcctaacggtgctaacttactgtgtcaggactgacaggacatctgattgattattatggagcggagcggtcagagacacaacaagtcactctccataccacagaaacagcaacccacacacaaaagccctgcctttctaatccaaagaagaggctagctggtctacgcagcttcatttcttgcaagagatgacgattttgacgggactggggttggatatgtcccagggtcaagggagaggggctgtggaccaatgatggatggatcagaaggtgttccatataccgactgtcgtttctttgcctctgcgacaatccgggatctggacatctcatacgtcgggaattaatattacggattacgattaggattacgggtctcgagatcctgtggcatctcaacggtcaggggccaggggggtaaggccgattgaccattgagctgggaacatggttgaaactgacggaggggattaaacttacaatcatggtaagtagtcagtcggtaaatacgcagatgagtcaatcaatacagttaagcagtttttaaggtccatcgcggcagggatgataataataataatattaatattttaacttaagctactaacgttagctagcctcctaatcctccatggaaggaacatgttcaccaccacccctgcccctacggagcgtcggaccgtccctacaggtggagaactgatcttctggtctggtttcgaaaagacggaggacggagttgtcatcggcatgacgaaccgcttcaactcgtctagacaaagccttacgactgacgactccataatccacacttccgtacgccattacggaatactctgtaaagtaatgctccgtaaagcacccggaaaattggcagagtacgtttacggagtaagaacgaccatgtcatcagaacctgctggcattatggtcaaaaagactttgtttttcatgcagataactggctgaacagtgttccaggaaaggaactacataacctattatcttgcgcccccggcacgtctttccacaggacagggacagggttcattaaaccctccaacggtcagccaccctgtcagctccgttacagcctgccttgccgggatctgggatcgaacgtgtctcagattctggtttctggcatggttggcactactaaagggacccggacgggatgaggcttagggtgtgtgggagagagttagttcgtcaacgtccagctgccatgccatgctccagcctctctccactgactggagactcagtggccatgtccacttgtcaggtcaagacgggcctggcataaggcctatgcatctgatgctattatttgacggctgctggctaggtatccattcagttacgattggcggaccggtccggatggcttctaatttcagagcgaacccatccttgttcgggttacgcgctggccgttgaaacttgcaaggcgagcccggccagggtgctgaagccaatcttctgacatgtcgtgcgtggaccagcttggataagtcggggatggggggtacagtgtactgctgtgttgtcaatcagcaagctgctgcgccagggcggtgcaggagaaacagattgcaacagaaaatagaaaacctgacgtagtcgagtactttgccacgctgtttctgcacaaagcagttggctcgaagtctctcttctgtgggagggagctatttccgaattagaaagccgatcattctgcaatacatgtacatacatacatagatagatagatatctgcctacggatgcaagtccatggagtgcagcaattagtccagtcaaccggtggggttgcttttccgtgcctggccttgagctttcccacatggtcacagctgctgaccgcgtctgcatcctctggccgtcgtatttgtgcggtggcggtgatgctgagccagtgatctaccatgtccttacctgatagacccctgtccagaggctatccagggctttaaacttgaatgttattgctcctaggcatcaacaataacttctcccgcattggccatcaatacttctttttctcttcgtcgtttctttttttttctctcttccagacttctcgttctgtgcgttctttcttccatttttctgaagaagacattccgatttcagcgatggcggcccactcgacgaccgttccagatcctggccatgaaattgcggtcattaaagttcgggtacggaagacgttgctggaactgcaacctgagttcgtcccgaaggaagataaacaatgtgtgcgaaagagcctcagcaaattaagatgaaggacaatccaagccagcaagattaccgggatagggtggggctgatggtggtggcttagccgagtagtctggctgctaacctgcagcgatcgcgtgttttgccctgggccgctgtagacggtcgaaacggatcccaaggcagcgaggacggaaggcatgactccctgaggagtcgaggagacagtgcaagccaggcagtggatgctccggccctaggatgagacggatgaatcatgaacggttgatcgcctgctaatctagagccctgagacggctgccgccgttcgaatggcgggactggtggaccctgactgttggcatcggtcattaaaaacatcaagcctcaaaccgcgaacgtgtgttctccgtgaccattgctgaatggcggccctggcaggcgtttcgacccgagggcaataatcagaaaataagatttttcctgccatacgcagtggcagccacaatgcggaggggaaaccttgaagctcatggaccgttagtcagcatgactcgtctgcaatcgagatctgaaggagcaactacctgtttttgaaggcgttgttcgcgatcagccagtaggagcaaggagcgaagagtatcttgcagacgaattccagtgcgtgcaggcggtgaagtcaccgccagacctccgcggacgcaaggagtgcacgatgcagcatgctcatcatgctcgggccgacggacaggtcacttatcgagtggcggtaagcgcaagagtcaccttctctgacgcgttgttgcactgtacgtactatgttgagcggtatagcctggccctgcacggcatcgcttggttgaaagcctaaggctggctgaatctgaatcgggtttggggactgcggtcctactactccatagatggcagttgacgggttgctcactgccggccatggaccggatctgattatggagtagtttccatctttctcctaaagggggcagattaaagtttctcgtaatggcattttcgtttcaggacttaccatgaatcatgatcctctccacaaaaccgatggagatgaggttcgagctgctacggtctgctacgctgtactctgcaccctacatactccgtactctgtactccgtattcccgctcccgatctgaagacacagaatactcgtccacattcctcaatcatgcaacggtcacttgctcctccggcgggggggatggatggtggataggatgcgggtctcaacttcatagtccaagcacgttgggcaatggtaccaggcaatcagttctagaacggacggtgctcggtgctccgcacgctccagatgctgtcccgtctgcgccatgattgccagtgtggaaagttgaatacgaaattgttgagacgaactgccaatgatgaggccatctttgcgagggacgtattccgtatgagaggaatgccagacgcccacctcacgggaatactgtgaaaacagccctgaacagacgtcttccaccatgaccatggtgagggacaacgcatcgtcgggtgcgtcgaagcggtgaaggaagcggaccttcgaggaagaacaagaaaagagaattgaggcgattggggtggaccaggcgttcacgaccaagggcgaggcggatttagcgtgcgtcggccacggtgatcactgacgacccaaggcatcttggcgggttggagccgttgctagcccgcccagagccagcctatcggagatttaactcgcagaggcgccaatcaccggcccgttgcagtcgtgctgcttgacgccccagagccgacaatgacgcgcttcctagcttcatttcctctggctcgctatagcagctcgccagggttccccggctaggctgggcctgagtccccagctaaagccgttggattattttatctctcattgattctctcctgctggagcttccaggttgcgaacggacgcctcaagtttggactgttgcaacggcaatcacgtcttccagaagccatcgaggctctcgaagtaataataaaacagctgattcgtgctatccttttgatgaaggagctggtccctctccacaatcggctgctgaaacaaacttgacgcgtggggcgtcgttccagaacccgcgaaaattgcacgtccagtttcacgtcctctcggccgtgagccctgccatcgtggggtttcatgacatgggctctaatttcacagtgtaatgagaatcctggttccctcgttgtgattgctatcgtcacaattatgtggttgtcattggatattggcggtgtttacaaccgttcaaaacgggtttaaagtattgtttcgaacgtattggatgtctttactcagcccgtctaatatcagacaaataagagcaaaacatactgtcgccacatgaatctgattattataaagcaccttttttttctatttaggaataaaagtatataataaaaaccatatgaaataaagcgaagaatataatatgagtgggaagcccgcctggaagtagcttatcctaaatgttctcctttccacatgccactacaccacaatcgtatgtgagaggagcctgtgctcgaaagaaaaagaagaaagaaagaaaggatattctactactactcctagccacgatgtggcaacgccagagcatgcgaaagatacctcattgtatcaggcgctgctacatgcaattattgaaaaatgtcggaccacgtcagtttctgcgtgagtgcattgtacacatagagtacatgatgtatgacgtggaagtttcatcagagcctgtagacaattgagaaatagagccaacgcatgcaggactggacaaaaggaaagtttcttgggaggaggccagcctggcagaagtatcttcctcgtggtctaacgtgtcaacagttgcggtgtggacaaagccaagctgcagagggcatcatcatgcgtcaatgaagaccaatgcatcatccagtcagttcaatcaaaggctttctctcgctctcgaggcagtgaggagagggtaggcatcgtaagaccagctcataccgagttcgaattatttccagccaaaaataaaatgagaggagaaaaaaaaggaaaataattctccaccgtcatcaacgttatcatgacgaccagcagctgactcgacacaaatcaacattcctacgtgcgtagctcgcaagcggatgattcgcccacaataggttttagcaaacagactagcgagtcaggaaacgtcaatcgttcaagacaagaaggcacatagtcttcgaaaagcattcagaaactgcgatcgacgaagtaccatatggaggatcctttgaaagttgagggtcgatgcaatacagtattaaaaggcagtattattatatccacgcctctgtttagaagagggtctttattttttttaaaaaaaaaaggtgtaatttatagttctaattctacttaaaaaaaattttatataaaataattatcttagtagatgttaatatctatctattcctttactaactagtgacattctgctaatatatagacagccaccaggttatattttaccaaaagagaacaaacgatagcgttgtctacttttaaaccgagccagaagaaaatatgatagaggctatacatagtaacctcctataaaacctttcgtccttttacaacctgctcagaaaagggacaagaatattcactgtcgcggtacaatgcggcatccacgagggaaggacctttgacagaaagcatggaggttccatctctagtcacatgggatgcccgtgacttgggtatggatattccattccttgtacgtagttggagaatccttcctccatcatctcattgcttatccttcataacaatgcattactgctttaagcattgacattcaccaacagaataagtggtatgattaaatgaaaccggaagggaaagggggaaaaaagaagagaagaaagtatgttcatgtaagcccaatacagatcatctccatcctggtatcaaattgcttcttgctttgatcgctacatttctagacgctgacaaataatggcatataccgtataggcttgtatgaaaaggtgcagcctactattgtgtttgtccaacttctatctgaatggataactacatttataattaccgcgcagaatcatacccgagggaagaaaagaaaaaggcctagacttgagtgctgaattatacccaggcccatgtccagaccttcacctgcctatttgggtaatatatattctgacagtcagctgataactactgatggtattattatctaagcggtagcagttgattagtccactaatcgacaattttatgaatccacacaaacactcgctataatacttccatacaaaagatagccaagtaataatggtttatatcactgttacttttgatgatggattcttcgcaaatcagcctgagatgtatgctatatacggatgctatttctacgttacccaccctcccactgaattaggtggtgatcacgattctttttgttgtgcatattattatccagaagtatcctacagttaatacacaagggttctcatttcaaggtctggctgcttgatgagctaagcagatctctatcgtcggtgacaccggtgtacagtacaaggtatacctaccggtcaccattgccctcgtcaaagacgaaaggtacatacgattgttgagttctaacctctgatccgaatttcgtcccgcaaacgcgttcgagactcccggaaattttgaacttgtcgaagggacgtatgtgagtgaagagggcttgcgtaacggttaccgtggctgcacaggatggagcatttgtgaacgtcgataccgacggcttcaacggcggagagaagaccgaaatatgctaagccatctatagctacgtatcgccctggaggccttcaaggagtccggttcttcgtatacaacagacatcacatgggcttattcacgacaggactggacgattgcgggcactatatccagtggctctttgattaccaggaccgagcaaaagttagatctcagggtgccaattgatcacatccacgaccatgaattagcaagagtcttcatggaagtcaccagctggacatcgatttgggtgtctattaggaatcaggctcttaagtaaggccgcttcccaagatgtcagttacaatacagatcccaagggtttccacatcaatgactagaaggcagaatttcacaggcttttgaaactggcgagaaaaaaatgtcgctcgtctttattataaggcagctggacaagatccatccaaacatgatcagaaccgtagacaaatggttcatcaaagaaagggaaggcagcagtcgaagtcggctgaaaccagtcctgaaaatcccaagacaaaaggataggctatgatattccaagccaattcgattctagattgaaaagctttctatcaagaagtaatttagcccaaccaatctcctgttgatgataccagtgaaaaaattaaaaatacaaggacagaagcaaatagctgttggaaataatacaatatttccccccgtagaaacccatccggcataatcgcgacatgtgtcaagaaacccaggacatatattaccctgaaatgaggtgtaaaagggagagctgggtccgtttaattttcggaataacggctgctctcgcctgccttactcatcagcaaacttccagagccctccaggtcgcatggcctctctgtatcgctctttaatcttttccctctctaattcctttgcttcttctcgatctctggccaattcctgcgtgctcggcatatctgtacgccagaaaccgggaggggaacgatgacgctcatgtgcatatctgtgtctaccaaatcggtctgctagaaacctggccttcgcttcaacaagtagatcttcccggtcttggtcgctgatttcgtcgagcacatgcttctgatcaccaagatactcctccaatatctggcggtctatgtccgccgactgaatacctccggctcgtgccatagcgcggaacttgtctccgcagcagtctgcacgcatgcagccaggcagacatatccgccgatcttgcttgcggacgacctcgtcgaaagcaaaatcgagcccatcgttcctttccgtattgaccttaaagcagctcaggtcgagagattcaagcggtcgtgctctcaaaggaacgtgctccaaaacatctctcggcctctcaccattgtctggttcggaaccgttggtattcgacgtgatgcgtctctttcgtacgtgcaattctgatgagccatcaaacccgcacgggctttctgaaggcggattgcgttctaacgggaccttccgagatcttaaatcaaagttgctccgattttgcgaagagactgcagatgtcttaggggatccttggaaaagtatctgacgtttcagtggtgaatgtgcctccaggagatcatcgagtctccggtgcgccattggatttcgagaagcggaatgtggcacacgttcaagactattccgagacatctcatccctatgttttctgcggggaccgaaattttcgtcttcgccgtcttctgtaacagcaggaattgcagcacttcccctttcagagacctttattcgtttcgagctagaaaatacgacggcctgattgcagctttttctgttgtcgtcttttggctgaagtgcacgaagacttttttggtcccgtctaaactgcccctgctgacgggggctcgaggttgtctcctcaaatacaacaaaagattgcttttttggtgtcctcacagaactaccgacatcatccaaatcctgcgttcctgaagggtttgattcgcggctttgaaaggtgctttgaatcggacttgaagatagatcctcgctctttatattaacaggcctcacctgggcgcgatcttcgacatggataccttctggattcttttctgatgcagatggagcatcgtggggtggacgactatcgccggcactagtcggttcctcagactgtgtcgataacggatccgattcggggacattcatcataaccacatggtccgaatattcatcgcgctcctgtttcacttgcggtgtagaatgaataggatctggttgaggttgaggaaaggaaggcgataatggctgttgtatagcattttcactgactgagaccgtcgggactgatgaatcagccttcggattggaaggttcggtaggcgcttccacggcgctctgtggaactagatccgatattgacccttgcgaaagcgataatgccagctcgccatcagtcaagctctcggggcctcgtagagttttggatgttccgtcaagacgtctgtttctgaccacagtcccttcgacaggcgtagccgaattcttgtgagagaaccaacgctgccattgagcgactgtatgtttatgtctcttgacttgcgtcctgagggaacctgttactttaagaagagttctaacgtcttcgtataaagcacggtagctgcattcaagctgctcgagggcctgacgaaagttgccatcggggttattcggatcggcttcgcgaacagtcttgagcaatctgtcgggatcgtacgtctcttgcaattcgtccaacttgtccttgacagcgctctgatccttgggtcctatattctgccagcgtaggtcctcctgaagacgggaaacctgattctctaactctcgtatacgcgcgacatcgtctctttgggcatttttcgagagctcgatttctttctcaaggtctttgattttcgcatcacgagtagcaacctcagcggctaaatcgcgataggcccggtcaaagtactgctcgaaatcttcagcgagtgacgcttgaagttttctcaatatatccatccgtggagcacagcaccggggacatcaacacctgaagacaaaaaatatacacatggagaattgcagcgtgaattgcagcgtgaagaggtttgatcctgtccgtctgccttgctgccgcgagagacgcggcttcggcgacgcgctgcaaacgcggaataggcattatacctttttaggtaagcaggaaccacccggatcttatcgccgcacaagcaccttagataagcgatcaaggtggcacggccttcgccgaaaggcatcttgaccagctatcatattctcgctgagcttgcagtcctctaaacgatagctatccccgtctgaacgcgttaatcgccaaaagaccgaatacttctggccggaggaatcttactcctcggcatgtcgaaacgatgtagggacgacgaacaaacagattcgcctccctcgaaacgtcactgcggcggtgaggtagatcgggtcgatcgtctgtcatccttaagcgatgaaatcctcctccatatcttgtcatttctaccgataccgtcgctcattgtctgtcaaaggtattcgctctcgcgttgtaacagatcccctcgttactgatgttgtgataggctgtcgcgtcgatttcatgctctggcgggggattcggaattatggaagcggcagtacttctctcgatgggttttgcccagggcacgccgtttgccctacttcaaacacccgaagttttcttcagggactgactattctccaaaagtctcaaaatggcttggccatagccatcttgcggaggagggcaaagtcacgcattggaaaacgcagtaccgtctgaggcacaactggtctaagggaatctgtcgagtcagagaggttgaagtagcccaaccgccacctccgccggtattggtgtggttgcactcagggtttgtgtttacggcggacaaggagcatggtctacgagcatggtctatcaaatatcacaagacatacctcgctagcgtctcgttcttgagacctgacaccgctcccagcgctctttccgctacccagggatcccaaacgtccagtattgaggttattgtaggatttgaagatggcactttcgatgtctatgacctggacgttgccaagtcgaaatttgtgctccattattctcacgtcggatcaacccctggggctatcactgcgatagcatcctcaccaccgtacctaatgatggtatcgcagcacaaagttttgtccttatataaggcgtctccgagagcgacaagcgttgacaaacccgtcgaatcgcctcgattgttagcctctctagaggccaacaacattttagccccaatgtccctctccatccggtcatcgccatccgaaattatagcatccatagcgtacaatttctaccatattggctgcggatggtccataggaattcaggagcttcatattagccacgacggcgaacatctcagctcgcgcctggcaacaacagtcgattctcaatatagcgcgaacaatgcgcagacgccaatcgagcctacaaagatgaagcgccacctgggcacctttgacagccctgtggattccctatattctacgatgtcatcaaatccatccatacgacacaatgagcctcctacgtcgctctcttattctcacccttatcttctcacgtcccataaggacaacactctgaccatgtatctcgtggtttccacttcagacaaactcgctatcaaaggtgctcggcgtctatggggtcacacatcgtcggtctcaggtgtgcaagtcagcgaccgtggcaaggcagtatctgtgagctcgcgtggaaacgagatccggatctgggaacttgaaacggtaatatcatgtccaaccgcttcgaggagggccctgaaaagtgaaagcagcgtccagattagccctgagaacaaatcgccgagagatccctctggattccgcacaatatccgaagccatcaattgggggcgccagaaatttaagacggagcccgagggtacaccagacgaaccaactcgcaccggaggttgggtgggttttgatgaggagcaggtagttgtgctacgtgagcgaggacacgggacccaattacttgaatgttacgacttcacatagaatccatttagaggcgaattggcggtggtaccaacatagagcattacgatatatagtcaatataaagtgcgatttccacttgtcccttctgcttgcacgtctccgtcgctgcgggagaccccggagcacatgcattattaagaataaaacccctgcaaagaaccctggcaaaacccgactagattcgttgtggtgcaggactcgtgtgccaactacctccgcatatacatccacatctacaggttctacagattcaaaccgtcctcaatgacgtttccatttttgcggctgaatcagagcatcaaaaaaagcattgtctgcacatctacgacgcgatgtttactgcctccactcggaaggatggctgccttatgctaccttgtgagccatgaaagaggatttttgggaagtaccatatacagctagttctctcgagaaccgaccgtcattgatgaatctggatcgttcatgatttacgcagaagttcgcttctctctcttacgccttctgttttctcagtcttgtcgcctgtgtgtgacattgctccgttcaggggtttcagaattccatgggatcgaattgggcactcgagcgacgtatcattatttatttcgagctctttcggatgaatatgaaagttccgacaaagcattgcatgatgctgcaatcactcttaataggacatggcaaaacaagagtccatatggaccagcctcagagcctctagccagggtatgaggacactggtcacattatgtgattatcgcaaaccattgaatagataaaagatgaatatgcgatgacctgggaagctcaaatgtatgtacatacactctcatgcttaggtactaatgaaggagtgctgaacactgatcagcaagctagtgtggacacaaacaacagtgacagaaggccacgtgaattctcccagatggagcgcgatgcccctccttgactacaaaaatggcaaggaaaattcccatatgtcgatcacctatctggctgaagatcaccttcattgatgtttccttctttaccgcgccacttcctgcaagctcgaaccactaaagcgagtacggtgcggtaaaggctaaagcaacaccagtactccacacagccaggaatttctacttttgattttttgaaattctctcttttgccacttttcgtcccttcaccttgacctttcccgctccaaatttggcaggagtttctttcattggaactgacaaactaaggtaagacttgagaagcaaatgctgaagctttccccgcatcattgagcctttagctttcgctcatgaaatttttaacctttggatctcctaaccaggttccgttccaattcaccccgctgaagctctttatccttcttcaacctgcgtcgccaaagaaagatggactatcaagctgggagccgtgggtgcttcaactgtgagttttccgatcgtggtgcctttattgccgcgcgtcagattgcatatatgcagataattttgcaccccactgctcttcagtgaagtaggcaatggttctcccttcctgtttctgaggctatagcaataatcaaatcatgatcaatgtaaacttcgagtttcattggcatcattggcaattctattgtcttcaacaatttttttctatttagaaccatcttcagctgttgattttagctctctactgacattctttgtcatgtatataggtggtgattcctctcatcaggtaacaatgcccacaagcccacattttgaaagttggaaagctcatttgtgacttggttccaggctcgtgattgtcctaagaaaggcactcctacttggtatgtaggacttgtgtgcctctttgctcttctgtctaaattgctgacaaacattgttcagctataactgtggtggtatgtttctggagtcctggtgagattatcacaaatagatcctaatgaagtcatcttgtgtaggccagggacacgtcagtaagtcaatcctttgtgtccacatcaaatgaagattgaagacaagctgacatccatcttaggccgggaatgcactgtagctcctaaggagaagtcttgctacagatgcggtctgtcaggacacatctcacgtgaatgcacccaagccagtactggcagtaacttcggtggaaacggctactctggcggtgccggaggccaagaatgctataaatgtggtcaagttggacacattgcccgtaactgccccggaggcaactacggaggcagccatggaggttttgggggtcgtcagcagacttgctactcctgtggcgggtatggccatatggcccgcgactgcatgcaaggccagaaatgctataactgtatgttccacttgttcatacttactatgtgtgtgttctgtttgtttaacgatccattctaccaggtggcgaggtcgggcatgtttctcgcgattgtcctacagaagccaatggtgaacgtgtctgctacaaatgcaagcagcccggccatgtccaggctgcctgtcccaactagatgaaaagtatagtacggaacttgcctatatgctgctaaatccgtacttgttgataggttacgacaagggggagaggagtctggtgattcttctcatttctatttttattccttgcgtttttttttaatctgagatacacagcatgagccctttgtctagcagcagaagctattcagcggtgactatggcatcaagataccatttatcatctcgtactacacgatttttcatttctcgccttattttacaactagaatatatatgcacaagaaaccgacactgaaaatgaccacctctgacgctgtttccagcatcattttcacaccctcttcccaggtagtcttgccgccctaagggaatgtcgcatgcctgaagcttgcctgaacattcatgctcacatgccaaatttcgtatcttaaaactgcaagaagttgttgctacaaaattggtcaacaatgcaacttgagtcaaccaatttaagccttcttgccagccaagggagggaaataggtgctagtctttatcataatgcattataacacagacgctgttacagatatcattggggtaatgacactagaaagctcagatcatttatccccagtttgcaaaaaattcctcatttcatactgaggggggtataagcaggcagtgagaagcttttctctccaagagaaaatgtaattactgcaggatgaaactcacaaagagtagcagtgcattctcctcctccctctcttgctactttcgtttcccctccttctcgccgcttttcccctttcttttggctttcaatcagccgactatttggatagcgtggcacccatgtccttcttcatatgcattatctgactagtttaacgactttccagagcgtttgaaacggcgatgaccatcatcctaaatctgtcattacagctgcttgttggattccaggcaacccaatcgacataaagtacttattatactcttaaaccttcccagattcctctaaaattgttgttttacctctttaaaggtttcataacttctctctaggcgctgggacatccacatttggagctcatatcctttagttctaaggctcggacatcagccctgatcatgcaggtttctgatttaaagttgtacacgagctgggcatgaagtcttgctactgccaggtggacattctgtccggcaagaataaaataaacgatggtgaaaagcaaaaaaaaaaactaaacgacacctctgggatcaattgatgattgggtgaggggagccaggtgtttctggtaccagggagagaatctcataaccaaaaacggcttgtagcatcgtagtgtgtcggtctgggaatgaaacgaggatcgaggtcttatacatccttcgtctgctctacgtggaaaaagcaaaggtcgcaaccagcagactacaatggactcccattctaaggagctatcgaagtatcttcaaggttttgtgaaggtgcatctccgacatgtctctccagcaaagacttctccaaaagaaatgtcactagatatgtgtgaggatgtttgaagttgatttcgatcgaaaattgagccagccactttcctaatgccaaaaatcctcctcgtctgctatgcatacagggtgaggatcttctagaggccgctcgtcggttcctcccacagaagtggcgatgcgtatacaaaatctgtcaagtgttgttctttctcttggaaccgtaaaatttcaaataaacgtccatagatcttcatgagggacgaatctccacaagggaacatcatagcacacaaaacatgatcatgacgcatgggaaattctcgattcttaatggatggttggggaaatcttccttctctaccggcccattctgtttgtagccatatccaaaaaaaaaggtcttccacgaatgtcacttctgtttaatttcgaattcttgaacatgtcatcctgtctactttctttttccgtgcaactttacatgcgaagaaatggcactattccaaagaaaaagagccaaaagccgcccagttgctatgggattgcaaattcacctacaagacctagccatttcgaggaaaatatcgacgcctgaacattgaatgtatgtatattcaatggctgggttggcatgacatccagctacagaagaattctaagaactgcaagtgcacatcattgctctcttgaatcgagggacatccccacagaatcgttcctcttcttctctgttcaagtcccatttgtcctgaaatgggttaagggccatgtgcataacccgaccaaggatctctcggtctcctttgcgttcaactcgctcgataacctcgtccagaatccaagaccgtggcagaaactaaagacgcgtcagctccgcaattaacaaagcccattactcaaacataagagcagctccgatcatggggttaatttggaaatcatgcctaccttcggattaactcttttcatcgcttcctgtctctccgtatccttgcccggaccccagtcttcaaggacgcgatttctccagctttctagccatttgccaatgcgttccttggcagagtcttctgtattcccaatcccaccaactccctcactgtggaagaaaatgggggcaacattcttcctttgttcttcagtctcgatatcgttcaacgctacctctgaaagccttctgaaaaagtgattaaaatcaagctctaacttctccagagtgtcaagtaactcagagaaaagtttctcaaggtcggagtccttctgtgtctgcaggcccaaccgtaggctcattagtctcttgtattcgttcagaaataccgtcttgtactcttctccagttctttcaattatcgtttcagcacgtttgataagaatcgggccataatcttcggtcacgcccttggcaataaatgtttcgtcgtctaccttgtcaccggcgccaatgagctcgcccaaggcttctccaagcctcacaagattccaccaaatgatagaaggctgattcttgtatgaatacctgagcaggtgatcatcatggttcggcgtataacgagggtcaaagttgtccatgaatgcaaatgggccgtaatcaagtgacaacccatatattgacgtattgtccgtgttcagaaccccattcatgaagccatacgcttgccacgcagctacagtcttagcgttccttcggacaatctcgcgatataatcttgaaaatcgattttcctctgctccttctttcccctgaatttcttctggtggaacacctctgactgggttaactacttcatctgcagaagcaccctctttcgtcaaaggcacccatcctggaagggactcccaccccgggaagacatcttcagctataaaagtcgcgagcttccgaatcaggtctcgatcattgcgtgcatgcagtatatcaaaagaaccaatcctgagccagctctcggcaaatcttgctacgatagcacccggttcgatcctctctctcagaactttggacttagggagcaaagtaagagaaagagcccgggtggtcggcacaccaagagcatggagagctgtacattgttaaaaaaggaataaacattgggtgatcaccgaggtcctgaccttcagagactatgtattcacgaatgcttgatcgaagaacagccttcccatctgcaaatcgcgagtatggtgtcctccccgcacctttcagttgtagttcgtagcggactttagtcctagggttgatggcttcaaacaggctaatagcacgctgtggcactgtcagaacgggcctttacggcgtgtaaacgctgaggacactcaccccgtctccaagttggcctgcccaggaaccactacgtctgtgttaactaaccaggcacaaaaaaaaatctcagcggctattaagaactaacaattgccaaccttctatatgttaggagatccttcagttattttgcagctcatagccactcacctccatagcattgtgcccaaggataaactcctccgtcttcctcactccagaatatcttatttccggcgactagcgccttaaagtccggcgtctgctcctctccaggcctcaggcctatatcttccattgcctttgggctcacaccaagtagctccggttcttctgccctttctggccgaacaaacgtgtacatggccccttttacgaggcgtggacccaaggtctctcgaggtgcattatgggacgactcgggcgtttcaaaggccgggtctggaggaagcttagaggtaaagacattcgactttggtagttctgctaacgagaccccagctgtctggctgctagcctcatcggatagttgtgatgccatctggctgatgcgattccgaatcgttcgtgaatgacggggtagattgtaacgaaacatatacaagatggtcgtcggaaaatcacaacaaactgcaagggaactagaatacagaaacagtaagagtaatatattgcataggtatctaggtactgagcctttgcctccgtatttgctgagttaattgattacataccactaattgcgcaagcgaccctaccccccccctctcggtccgccggtccgtccccgcagtccattcaggcaatgtgacatcatttgctgcaataggtaccactaccatatcagtattcattccgattcatgcatgttgtggcaatgaatcaaataaacccccaaagtccgatgtctttactcatatatcatcagctccgtgcgatcatattaatttccgcgaaaccgtctctattgctattacatatatgccaatgacattcttctcatcatagccgtgcttatcgtccaatctgcaacattccgggaactcttctccattaccaatgagatcacgaaacaataattaagttcggcaacgtctccggaagtgcgttgtaacaactgcccaatgatggcgtagaagtcggcgggcttatagccggcgtgtgctccggaagatctgtataatttgccggcagagggtaggaacttcctctctccttcctgctattcggtattcatgctcagactttatcaaaccttaagttcaatttcaagcaagatggccaacgtcgtagatatccctaaggtgaaaatcgcagacggcgtttccataccaatcgtaagtccctcatacggaatcgacaggcctggttactgaattagttcttttagctgggttttggaaccggtactgcttggtacaagaaaggtgatgataccagtatagatcgcgagcttgtcgagacaatcaaaactgccatcaagctgggctaccaccatttggatactgcagaagcttacggcacagagaccgagttgggtctcgcgatcaaggaaagcggcgttgcaagggaaaaactctttgtgacaaccaaggtttccaaaagtataaccgatatccctaatgccattgacagaagcttgaagaagcttcagctcagctttgtcgatctgtatgtgtctagtctgtcttcccttctcgagccttttttttctaatgtaacttgtcgaacagatatttgatccattcaccgtttttcgcgaaatccgacaaggatctccaagaagcgtgggctgccctagagaaggtgaaagaatctggaaaagcaagggcaattggagtgtcaaattatacccagcctcaacttgaggctacgctgaagatagccaagtacccccctgtcatcaaccagatcgaatttcacccatacctccaacatggtaacctcgtgccatttcagcaagagaaaggaatagcgacggccagttacggacctctcacgccggtatctcgagcaaaagggggaccattggatggtatactgtcagaactggctgcgaagtacggtgtcagcgagggcgagattgccattcgatgggcaatcgaccgaggtgccatcacgattacaaccagtagcaaggaatctcgactcagtgactacctccgtgcactcacattcaaactgacgccacaagaggtcaacgagatttccgagataggccttcagaagcatttcagggccttctggaataacaaatatgcaccagatgatcggacgtgaaagatggacttgattttgtaatcgtcggaaatgtgagattatttactgggttttactactctaacaccgacgcaaaagagaactttggaacgctaccccggagtaatttcaactgcgtaaaaagcgtatgtggcaagaatattcatgcctcctagaagcagcaaagagatcctacgagacagcaatatcaaataagaaaattgcaatctttggatggcaacgctggtgggatctttaagtcccatgttgggctagctgcagaaaatgggaaaataattggaccaggcagccatctgccatctttcgtcgctttcgagatttcatacgttgcggggagatgttgcaacctgcagtaaagaacagacccatcatgagatgccccaaacacgaagattgggacatcttcagtcgctccagctgggatgcaacaaagtttttcttggatcatgtagcagaggaggaagacatcggccattcgtgtaagaaaggcctttcctaccacctacaataatcatgtccgtgggaaatgagtatcttggtagaaagagaaaggaaagagaggtctggcagagcacaccaaacaagtgaaaattgactgtgaatggataaattgaccttccgaatctccggaccaatccggaggcgctgatttgggacgctgaagacaccattcgggcaagccttggcaaagaacccgagagttcccagttgcttcaactgagaacaacagcgcctcctccattgcgtctgcttctccattccctcccccctcctaactggctacagagtaactctctgtttgtcctatcctccatcgcgtttttctaacacaatgcggccgcaattgctccgtgcggccgctcgttcgagacaggtcgctagggtcaattatcccaggacctttgcaacaactacgcggcggggagccgaggtggaactgacgatcggtgcgtgctggcaatattcgaggaaaaattactctatgactgacctgacagtttagatggcaagaaggtctcgatagaaggtaacctggagttccctccttcctcttaatggccattctcttacatactataacagcgggatcggcccttattcaggcctgtgagaaagccggtgtaactattccaaggtgcgtgactttattcatctagaaatgtggcggacatgagctgattttagatacagatactgctaccatgagtaagctacccctcctcagcgataatgtggcatacatactgatgaaatttccaggaagttgatgattgcagggaactgtaagtctgagtcgtgctggttaaccgataaaagccctggctaacaatggtaaaggccgtatgtgtttggttgaggtggagaaagctcccaagcctgtggcatcatgtgcctggcctgtacaacccggcatggttgtcaagacgaactcgcccttaacgcacaaggcccgggagggtgtcatggaatttttacttgcaaatcacccccttgactgcccgatctgtgatcagggaggggagtgcgatctacaagatcagtcgatgcgctacggtgccgatcgtggccgattccatgaggtcgggggcaagcgtgcggtagaggaaaagaacattgggcccttgatcaaaacatcgatgaacaggtgcattcattgcactcgctgtgtccgattcatgaacgatattgctggcgctccggagcttggaactaccgggagagggaacgacatgcaaatcggaacatacttggagaagaatcttgactctgaactctcgggtaatatcatcgacctctgccccgtgggtgcactgacatcaaaaccatatgccttccgagctcgtccctgggaattgcgtcataccgaatccatcgatgtccttgatgccctgggttctaacatccgtgtggacacaagaggcatggaagtgatgcggatactccctagactcaatgatgatatcaacgaagaatggatcaatgacaaaactcgatttgcgtgtgacggattgaagacccagaggcttacgacgccacttattcgcagagaaggcaaatttgctcccgcaacttgggagcaggctctgactgagattgcatctgcctatgagaaattgagtccgaaagcaaacgagttcaaggccgtggctggtcatcttgttgaaactgaatccctcgttgcgatgaaagatctagccaacaggctaggttccgacaaccttgcgcttgaccagcctggaggcagctcgccaattgcccacggtgtcgacgtgcgatcaaactaccttttcaattctaagatcgtcggaattgaggaggcagatgttctccttctggtcggaacaaaccctcgccatgaggctgccgtcctaaacgcgcggatccgtaaacagtggctgcgctctgatctggagattgcgcttgttggcgagactttcgacagcacgttcgagtttgaacatctcggaaatgatctttccagcctaaagaatgctctctctggcgagtttggaaagaagctggcctcggccaagcgaccgatgataattgttggtagcgctgccgctgagcataccgacgcaaaggcaatcttcgaaacggtgggaagctttgtcgaaaaacatgcttcaaatttcaacaccgccgagtggcagggttacaacgtgctccagcgtgcagcttctcgggcaggagcctacgaagtgggcttcaccacaccttctccagaagttgccaacacaacccccaagatggtctggctgttaggtgccgacgaaatcagtgcgagtgacattccaaaagatgcatttgttatctatcagggccaccacggagatcggggtgcccaattggccgatgtcgtcctcccaggtgctgcgtatacagagaaggcaggaacctatgtcaacactgagggacgtgttcagatgacgcgtgcggccacttcattgccaggggctgctcgtgaagactggaagatcattcgtgctgtcagcgagttcttgggggtacccctcccttacgacgatgttgaggcgctccgtgaccgtatggaagagatcagtcccgtgcttcgtcggtatgatgtcgttgaacctacttctgtaagttctttgagcaaggttcagttggtagatcagaataagggcagcaagccgagcggagcgcctttcaagaaagtcatcgaagacttctacttcaccgattcaatctctcgaaggttcgtcataaaaagtcgagtgtcctttggatcatttattaactgtgaggtatagctcacctacgatggcacgctgctccgctgccaaggctaccggtaaccccgagacaaatttcatggccccgggtgaactgtctcctcaggcaatgtttggctgaaaaaagaaatacatcacgccaattctatcactgcgttatttccggtctaggcgtttgtctttgtaccacctgagttttctattttatgtgcctgtactttctcccagttttcattattatgctatcactgttctcattctcctttgttttctctcccaagaggcctccgtgtcagggtgacttgcggatgtaatcgatctctccgccattaggtattattaaacggtggaacttgtatataagatgaaatcggatcaaatttagattatgaaagaaccagaacaggagatcgattgagggagagatagacacaacaaatcaatcctggccagttcgacttgtcatatgctcgaatgcaacggaatttctttaattcctattttcgcgaaagggagttcaagaatgccagacgggctacttcaaatttgtgcgtcccagcgtcgaagatagtcaagtatagctacatcatttactaaccaaaaacaaccactcgatcatgaccaagttggcgacttggggaggaggagtagcaaaaggatgtgttaagcgtgcacctatcgaacgcttttcccagttacaactcatcatcatcagtctcaccggccgtctcatcagcttgctcagtaaactctgcaggttgatctcgtcgcggtacggaggactttgcctgatcattcgctgcagccttcctagcaaacggaagatccctccggggaggagggctggtaggaggtgccaggttcgggcgatctgatttgtccattacctggccgcgcttctcatctttcctatcaattctaggtggagaagtagataccatatcatcctgatcctccgtctcggtctcatcttccaaaggctgaggcgtctcccggccctcgaggtctgtgacctcatcctcaccatagtcatcttgatccttcgctcggtcgatatccattctctcgaattcatcgtctgtatctgaagtctctggcatgttgtccgccactttgcgcttgttggaccgactcgtctcggtaggccggtgtccgcgacctgaagttgcagctcggatttcagacactgaattaggggggaaaaaattccccagttagccagatgccaacttttccgctgatgtggaggcgatgaagacataccctttcccatgtcaactttggccgaggccagcaggcgctgttggtttcgaatcttgagtttcttctcattcaagacctgcacgaagttcatcatcaaccggttctcgtgctcattcttggcctcgacgagctcctcgagctgggaattgagtttgctgatggtatcttcagctgcttgcaatcgctcagtcaaggaggagatctgctgtccgagagaatccgctctcgaaatcataaggctggtccactcgaaaagctcgatggtctgatcgtcatcctgcatgagagtaatggaggccactcgttgctatgggatgggcatttagtaaggtggcatgcgatgagctggttccagcaatgtatacacctaccgtgatgctatcgatccttttcctcacggtaatgaccagctccttattcttgtcaccggaaccgcgtatggaggcgcctacctcgagaccaggtttgcgcccggtctccggatggacagcaaacgaacattggcccagaacggtggtgaggatctgctcgaattcctgatcgcttccctgatagttcttagagcggaggttcttgagatgggactgcttgactgagctgacgccatcagcggaccatgacgaggaggatactcttcaaagcggcagtagagacgcacctgcaccgacgtagggactttcgccctccgtcgcaacgagctttaggtctaggggagcctttccggagcgagagacatggaccaagacaaacgtggtgggatcgtcagacctgggaatacggaggacacaggcctggtcggacatgatggacagcggggtagagtgagatggaactgtgcgaggcaaatatcatcttaataatagattatcagcgcgttcaggaagttagatagactccgtatagcactccatactggcgttcttgggaacgagatacgacgactaggctgcagctgctcatggaggcagcgggaaacgagtgggaccagttccaggtgcaaacgacctacagaatggttattcgctgtactctgggctgttggttgcctttgttgtgttgatcggccagttttcatctgctaggctatgactcgactcctctcatcatcactaccgttatcatttctgacgcactgacgtattcgcggtgtgatcatgacgagagctgggacatgcgggtgacatctgcgacgcgtctggcgcgtgcgtgggcattcttctaggagtacggctggctccagccctgcggcacgggcccctgccccttccacctccaccatcgtgcctccccaaagtttcaacgctcgccagaaaggaataatcgctcctggtcttccaagttcaaatcctggcccagccacgacctccccgtgcccattcttcccgccatgctctgacagatactgccacggccacaccgtgttcatgaactcctctgcatttgcatccccatcgcccgccttctcttcagcctcgcaatttcaattcggcattcttgcccgcctttatcaggactgctgcggaacggcccgtgagacgtgcctcgttcacaatttgtcacacgagcacgctcccattcctcttcttctgcttgcgccctgattgggattgccttgtcgagctggaacgcgcagttttcgatcaactcacatccagggttatttatctacttcggtcgtccgagtccaaaagttgaccccggacgctatatcgcccaaaccctgattgtccctgtcgacaggaatgtcattcagccctccgtcaagctcaacgtcaccgccccgtatctcttaactcttgggcccgaccgagcgagccttgtcgaggattttgctttgtctcctgaccgtcacgtacatggtcgcctcgctccttcgatcacactctacgactcgctccttccaatatgcaggcggaaactcttcgtctgcgacaggatggagagtcaattgaatgctgggatgacgacggagaactacaatgcacagatgacattcaattccacaccatatcagctgcgacatccgtaactggttctgttcgacgctccggtcatcgcgactccatctcgtcccgccggtcggcccgttcggatttggagtctaacgctggcgacgaagattggcaggtcttgcttcgtgataacgatgaaaccgcaaccgaagaagcgattgcctccgcacacaatgcgggaatccccatccccaataatgtccccagatcggctctgctcggtggcacgatcaaaaaactcggcggcaagaaagcgaagaaagacttcgtcgatgactggtccgaggacttggaactaccgggtgtcgacggtgagctagcgctgaaaactcaagatgaacaagcatttccagagactctccgtcaggtcagctcgtccttgtcaagtccggtcaagtctcagacctctggtgcggtcggttctcctttaggttctcccataggttctcccactgctttcctgcaatccaccgaagtcgtttctcccttgaacaagcatcgagaagatgacacatccgaggggcaagatgtgcccaccatcaaggtcgcccaatcacgctcgtctcagacccgcctacctgttgccagcctctcgggctctctggaggctgatgacgatgcggaggactttgagaaggatttcgagctccctgcagatgacctaccgttgaagctctcttcacccaaagacaatactaacacccctagccacaatgctgatgatttggatatcgagtgggcagagggcagtatcggcgttcgctttggcgggaccaagagggatgggcgttcaactcacagctcgtctgtctcggcactcagtcccagtgtctccagctgtctgacgggcgagagcgaagatgatgtcttggatggtctggtgctgcctgatgggcccctcaacctcgaagaggctttgaggaagcggcttgagactcgagtttcacagcccgaagacggtctagaagccaaattatcaaaagcggcggacgacaacggcgacttctttgcagacctcgaaattggagacggtaatgtatttacgtcctcaaagccaaccttaaacccgaacatcaaacgtaaaatagcccgtcctcccagtcccagtcgttccgcgaaaactatcacattcacgaacaagcctgttcctggcggaactcggatcccacggctatctggtcacgaccgatctcattccaatcttgagcccgtctcggaaagcggtgcgcccatctccaagtttcggagaccgcattcacgacttgcaggacattcaactcatccatctgtctctagtgcaggcgtcccatctcctccatcgacacctccagctgtaggccgaaggtctctggggtcgggaatctcgagagagggcttaaaaagtgacccgaccacgacgagtgctcagcttttgaaggcgaaacgctccatgccggccatgcgtgcttcccagacgtctacgctggcaccacctttccagcgcccgccctctcgtcaagatggcagcagtcgtccgccctctagtattcggccaaagacaccggtggatcggacaacgaccgactccaggttaagtctgaaccgtagacctcaggtaccgtttcttccagcaggttcgtcacagagccagtcccaccatgtcagtgtcaagtaccccaggcaccttcgccgtcccaactccgacagttcgggtgatacgacttggcaacgatccatgtcccatctttcgggccttccacgtccggacactcctggtcgcagccttcatgaaatcggtagcgaagccttggccgctgctgccaaacgtactgttactcggcccacccgtcggcggaactttggagatggatccgaactagagtcgtttgacgatctgcccacctctgcatccgtggagagtcgatttgtgaaaaacccggtcggacacggtgctccaagatccttacggagtcgtctgggccagagcacaggcgtatcaccatcacggacagggaccccggtcccttccaacctgcctaattcctccagatcgcatgatttcaccccccgattcgctagagataccaatgcttcccgaattgcacgagaacagcgcattgcttccttttctgtccctatgagagatcgcgaaggtgggcctcttgttccactgagtacgaattggaaagcgcaggccagctcccgaaaatcggatactacattgagcttgaggagtaagcggggaaagacagcacagacgtcgggatccaggccgcatctgatcaagccaatgggatcaggcgtcaatgaagctaaatgtgagttttatttgacctccatgaaagggttgggcgttaatctcattattttctctagctgtcaaagggatgcgatacaacccggccaaacaacgctgggagggcaacgaaaatgcaattgccgaatttgacgctgtatgctctccgaagtctcccaaagctgctcctgctctcattactagtgtgggtgcagtacagggcgtccaaattgtgggtgatatggtgtttgatccgcaacggatgtgctggctcaagcttgctcctatccagccagggaacaatacggttgcagtagtgcatgacgactgtgatgatgtttttgccggtctagatgaccttcaagagaagccagccgctagacatggacgaaccatatccggcggttcgaacgaattcgatgggtctgcgggttgggatgaccaaagtggtggagattcctcagaggagtggcccatcacagaagaatttgatgttgggccagaatttgtcaagcgacagagagctgaggaagaaaagtggagacgcaaagtcgataaatgggtcgcccctgatcgcggaagacttggggatagttggcgatgggctatccgggatctggtggcatctggcggtgtctttggtgctcaaggacatggttgctcatgaggacgaggatgaattcggtcaccgcattgccatcattctcatctctcagttcgaccctgagcagatgagcaaaagacgctgaacgaagaggcacgatggcttttttttttataatgactgttacgacacctttacattgatgacttgttcgagaagaagggacaaaaaaggaaaagaaatatggccgccattatacaagacccttgacgggagagtggctaatcttctgctcctttatgtcccttttttttacaatattgacgacgaaagagaatacccgttgacaaaagcggatgacgacttttccgcctgaatcgtcaaggattctctgatgagtgatgacaaaaagatgagttttccttattgtcttatctccattgggcggcgttggcagtcttgcttcggctttgcttcttgcctgtcgtataccaacttcttttctcgaggttcctgctgtgtgcagatgccgggtttcctggatcatctgtgtgtgatgtttaagttgcaactgtatcatgtaataatatcttgctttttgtacacctttgtaatttaggtctatgtttggttcttttttcgatctctcgctcttgtaagctgctggactttggcgaaaggtagcaaatgaggagaggagtttagagacaaggtctcaggacgagggccttggggttactctcgttctcatggagatattttggtcaggtcaccagggactgtcatttcttggctttcgaggaaatatcaagcatggtttacagaagaaagcgaccgagaagggggaagttatgttactaaatggaacgccagaaagagcgagcttgctctgccgtaaacaaaacaaagagagagacgcaacttgacagtctggagatctgttgctcgacgtgcctaaggaccgattagtggatatcattccataaggcaggagtgcagcggttggtccgatgcgaatcgatgaattcctgccgcatgatccaattagatagtaatccggacagtccgtttcaccggtgagatcccggcagcgagacatgatacttcctatagatccgacagccccatcagaagttccagagcgccgctctccgggccaggcacaggtctatgcgggtttcagttcggcaaagaaaattctgggccctaccggtaaaaaagacccgaagctcccattggtatgactgggatactgcatcaagcaagcttgtctgccctggcaagttgcggcccaggaggccatgcttgaacttgatcgacttcggagtatcgatgtgtggactatccatgctccctgcgcaggctcttcgatccatatgcaaagcgtccctaggatagtatccatgattgcagttatgctaatgaacaagcaggtgcattgggcatgcaactttcttaccggaatcatgaacttgggggtatgttgagacatgtatgcacaccgtacatcaaaactatactgcacctacatgatctggataatttctgggccgattgcggactagagggattagtggacatgtttaggtatacagctaatgacagctgcgctggaagaaccatgtatctaaaaaaaaagagagagtaatgccgaatttacaaactagggatgattcatgttattgttgattacattagtatatcaaccctatccatactgggccatcacaaacagcttttacaatttttcccgatatggaaatgatagtgactacctaccgtgccccccagttatagcaagtcacggccctgcccggattcacaggagtaactcctccaagccagcacttggcagggacatcaccaatgatgtaaactggatttgcaatttaacaaaactcaacaaaagggacggttcaagactagccggttctgcagaattttgcaaacaatggtaccggtcttgtgtcaaagctatgtccacaatgggtctaattcattgattagctactaagttatatctaatcatcgaatatcgtcaaacgtcccggacctgcacatgacaaaatagtacagattacacaacacaagaggcgctcttttcagagcaaccttgccccttgaactcagccaaacacattaagacacttacaacacatagtctgtaggtattgtaatgtcttctaaagtactgtgggtccactaacacccttggcaatgacagggaagtcaatgatcgttcggaaacatacatcgctgacgatgaacttacgaatcatcaaggatggacagtgtaaagggtccacgaaagtcttatctccaagtccaagcctcatcagccaatctgaatcctagatccaggagatcgccctttttttttgtttttggccccgttaaacttccgactcccacttgaacaaagaacgaagtagggtagcagaaagggaagacaaaagattcaaaccgagctgcgatcattgctgctgtatacacagtattgcatccattatcccactcggagcactaggaactgtcggtggctacatgtatccacaatgtgaccgagaaacggatcgttgtagctactgacttattctatcaagatcctggacagcctaggcaacatctcagcagattggtccccaaatatcgttatgcttgggaatgcgatgtttactgttctacaccagttctagctatgggtgtcggaccagatcttaattgcactccggcgttcatatgcatagccactgtcagggcactgaaattaatagaacgccatgcatttcaacacaatccatgtaaagagcgcaacgcacggaaccgatctaacccatttcaaagagtttcggacctggacaggacataattggaagagacttcctacaatactgaacagacccgaccatgccaatgccctagcgtggtagcactctatttgtcaaaatagtctgcagtacctcaacctatccaacttcggcgacagatctactacagttgggtagcaacccacatcttcgggggggagggtggggggaaagggtcaaggtaaagggatctcgagtacagtcgcagataagacggtgtacacaggctaattgcaagactgtagaatcagacgtgtaagagcaagcaagctctttagccttccgaaagcgggatgatcatagccaaacgtggtcaaaacgcaagagactccacccaggccaagaatgatcgcaacccgcatattcgatcttcgtgagggataagaggtcgcttcctcggggccaaggcagcctagccgactattgttctcgaatccaacactggcagaccccatatctagcgcatctactctacatacgtcacacgagacaggccctggatgtgttggagcgtgacacttggatgattcttttggcgtggcaggggtttggagatctccagcggctcacacgcgcagatacttgacccggacgccaagggaagtgacgcagtggaaagctgtagcctgtcgggctccgaccaaggctttcggccagcgcaggaagctggtgtcaagtcaatgcagacatccaatcatctgccagtggactatgaggaacaggtactcagtacagcacagtacaacacaaacattatgattcgagggacgatgaaaacatcgggcgttaagttactgggcatgcatcatgaccctagttgacagcgttgatgttccatatgcaccggcgtcaacactcttccgttattggtccatctcaacttcggcggtaatgaagacaggcattagaggacatcaacgtggctccgtgaagaccatcttaagtgtcttccacttcaaaggccaccgtggtgagacccggacatgacgaaagctctggaagcgcttgctctcattgggcttgcactgcccggcacgggcgctggccctcgatctctcgagctgtttgctgcaatacacagataagacgaagacgaggcccatgccaggcaggcttgtccatcttcaggccgaattcgcgcctctcattactaacgccttggaaatcgagatattccaatggagccagccatggcccgggtgaatcgatcaggccagctcctgaaactattcaaacccatgtggctcccacagccatagctgcttctcacaaatggactggagaagcagcctgcgtaccttacaggagcctactgccgttacatgtcttcgccttctttaacaagggtcccttctctatgcttctttgtttgccaaatcccctggttgcctgcacgtcagggttcaatcgttccgtgttgttcttctctcatcatgccagtcatctatgaatctacaacgcatcatacatacatacctcctgccttatttttcttcctcagtcctatttaaagccattctatttaacatagtcctgtgtcccttttctgagctgaccgccatactccgtgctttcaacttggcctcgccctgacgggaagaaaaaacagttccattgccttggtattctaaccgggcattagggaaaaaaaaagagagaggatttcagggaaagattggtgtgcattattgtatttgttttcgaactacgaaagagaaagagagttctttttatgttttgccctctccgcgtcacttctgtcattcattaattgccctttacttcagctgcaattcttcaacaattacaaaagcagcgatcttagcagagaaaaggccttacctctttgccagagaaagttgtcgacacttccccttttcttgtcatttttatagccaacggtcatttccttcaatgagtggtttgcatccggtttgtctggtgaaaacaatctatctttgtcattatgaatggttataggagacgcagcccccacgagcataacggttacgctaccgatcatcagatcccaatggcggaatgttatgaaggttctgcaaatgactttggctatcatgccccaaatccatacggcatcccccaccatccttttggttcttatgcaccccagtttgcttcatgttatgctcagtcaacttcagttggcgggcaaaactccgaaatgcgttcgcctctcggtcaaatatcagcacatcatcagactcttgttcaggactcatcttatcgacaacagcgttgtgtgagtccttcgagatatccggatgcgacacggttgatttcaatatgtgacatgttccctgagaccgaggttgaaagtcaagagtctccaaatgaagataccatgctgtcagagccagttatacctccattggaagggtttccagatgttcgagaatttgatcaacttatgcaaaggtgactatctgattgattctctttctttctcttttttgtttgtcgtgtcttggaattcctgcttccctcatagctactcactggcttacaagataaccatctagctatgtcaatgatttatccatcaagaaacaggataaggcattgatccatgccaaaagagcacgcaacatcaagacggtgctggttgacccaaaagataccgctgttgaatcagctcaattcaggtgcggtgtcattcttgtgcattcgtttatcgagtgcattaacctctgtaaccggttttctgagtcaatggatggcgctgagttcagtatttaggttttgggtcaaaaagatgttcaaacttcaaccagatgatggtcgaacaccagatgtatgtatcaaaacatacgtcagaaattttgcactatctgacctggtcctagtccgaaaaattgatctgtcatgaaggaaaaccagttgcaattcgagaaaaacttttcaagatcctaaccaaagcgcatcaacaatgccagcacggcggaagagacaaaacctcagcccaagtccgtcagatatactcatggtaagggatcatgttattgtcgtgatagcatagagctactgatccattcgcgatctggcactctgtcacgttactgccgttttatcaactttgtctcatcccatgtctactctatttgttcgacgtcactgacagcaaaaaaaaataccagggtacctaaagagctcatttcccgcttcgttaagatatgtccaacatgtcaggttcgccgtggggggttgcatttaacacctcctaattcgcgaagaggctcgcctcgccttgaggcaaccttgccttcgccaaagcttttgtcaccacctcctccacttcctgatcctacgtatagacggaaatctacatacagtcttccgggttcttcagagaggtcacaggcggatggcttcgctcaaggtcacgttgcctggacagacagtcctgcccaccttcatagccaactgcatctaagttccaggccgttcaatcatttcactataccaccagctggtctcctcactgacctttcgtcatcgacatcatcaaacgcattagtggatgaaacgtcaacttcttcgactcaggtcaattacaattctggttacatgcgcacgcacggaagtactcggtatcatggttattgacgttcatgcatttggatgcctgtgtgatattttacatgagaagagtcttacactcgtatgaggtcagagataccctttcttttctctgtatgggtaccatctcgaaacagatattattccgagactccgattcatatcgtcaaagtccacatgtgataatatctctctatcttcaatgtctcacgttctgctttatcttggcctggtatgagtaaattttggtttttttttctctctctctgcgtgtgtgtgcatttcgtagtgaatggtggtaagaaagtcgagtgtctataaaaaagctctttactcaaaagcctgagatcacttgcatcatttgtctttcattggcttggggcgcgagattatgatttgaagtagaagtaacagcaatgtctttagactttccggaagtactgtttgatacgtttactacatgctatatattccttgctagtatactgtatttcttactgtaatatctcttgtcgatgtgtagcctctgtgatccctcaataatgcacaatatataccacctgtttatattcagagatcatgcaaaaatggtgaattcaacaaagaatattacccttaatgatatcgcttcattttaactgctttgattgacacccgtctcaatggccaaaatgagatatccatatgctcacatgtacatacatacaataagtattgatatcattcagaatgtgtggttcttatactagagtatgatgtttaaacacatttggggtttatatggtaaaaaaaaagcactgtggttatacaatactggaccagtgtcaaatgtttcgtctatagaagaatacgtttattattagtaagaccacgtttgcctaattcgaatacagtagttcatcggccagtgtattatatttgtctcctccatgttaattgatgacaacaatgacttgggctttttccctgaaagactgtatatagtacaggtgggttatgacttatgttacagcctagtcaactgtggaatacctatgagaagctaaatctagagtatcaattccccattgacccgattgacatatgttcttccgcctgagaaacatgcatcttaaatctctaagaaagctccgttaaacattgttgcaacgcgaaagttcaccaatcagaaacacttattctgcagcgaaaaacataaccataaagacacgtgaaacatatttgagacagcaaaaaggaaccatcacaaggctgctcggttgattatttccaatccgttcgaaaatgggttacagcaataaagtggcggacgcaattggcagtcatcaatccaatgggaccaatcgcctgcttgcttgcttgcagtgctaatatgtcatttgaggcgaccccagagctcaggtcgcatgggacgcaatgcacaaagccaattaaaagaggattaattgcatgtcctgatttctatattagaaaccgaaaggcccagcatattctatggtcgcttgaaaagtcgtgacaaatagtaatacacatactataaaagggcaacacagagaacacactctcggtcgagaacatgtaggtgtccagggaaggtttctcaataccgtcctttataactggacgcgaatctctttatacatcccgagtcgtttcacactgggagtgagaattttttccctttcataactctggagtatggtaagtaaaggttttaatttaaaacgaagcagttggggttcacatactttgtgtagtagatataaaagaagtctgaatagagtacggtctggatgatgcccgctatgactggaatgggatgaaaatagttctcggtgaagtaacgatagatccagtttggaatgtatagcgctcgataaagccctagtgcaaagagataatgtgtggtgatagtatctgcctcgccagtgcgttgcaacatgaacagttgggggaggatagcaacggactcaagccagatagaaaatgtccaaagaatctgtcgcaggtcagaggtcattcaagccttcaaaatatcatataccaggtcattggcagctcacttcagagatagaatatcgctcgggaaataaaattgctaaaagcgcgctgaaaccaagaaggtattgaaccttgaaggtatcaagattggggtcgtgagtaggcttatagtcattgagcatgagataaatcgtatatgtcgaagaccctatgaagaggatcttaaatatggtgttataggcagagtctgtgaacgtccaaaagaggtctgtaatggcgcaaagataagtaccagaagaaaggcacaagttgattgagggctgacctaaatatcgggttacaaaaactatcaaatacagagcctgtgatttgaaagagaggccggaacagctctattggtctgattagacaaatttcagaatcactaacagagttgggcaatgtacttacactagaagacttcatcttgtgaaggaggataaaaatggatgttaagtgggaaaaatccgctggattcatgccaatcagcacaccatttccataagtgcagactcgagatgttgatattatacggcgacatcctacctaaaagcctgaagatattcatggtgatagtcacagactggtacacgaatatacgatgaaaccgagttaattagaagtagagagagcttgttcccgaatccgcaattccactagaagatgtaatcgccataaactcgctgcaggaaggttgcttatcgagtatgaagcttgaagcttacctttttcttggaggggatggaaagatttgttgacacgcagccttaacaaagcgaaccaaagacgcgaggggaggagcatcggaacgcgcgctgctaagccccacagcaaaaaagcatcctaggctcaacttgtactggcgtaatacggagtataaataatactcgcatgattgacagcccgaggcagaacctgaaaagatttgcccctctatagaccatacgagttctcgatgcttgcttgcatctctagagcatttatttggtgcttgtagctcaggaaatacatctgcgcactaaaaatggcaccctgtatttggtcaaaactcatacatcataaatactaataacaataagacttcaatggcgatgacagctgtctgtctggaggaagatggactgcagagtacagcgagtttatatagcctagaatgcggcgcttccttccagactctcaccctcagccatccgttgaagatgaccttcggcgagttcgctctttagtgcatttgtcatgctttctctatccagtctgttccagtctttcaggccgatcctctttagctgttgtttctccataacttgctcaagcaacttctccctgtcggcttcaagttgtgcaagtcgcctctcggttacaggatccaatactgaaggcaagattttaccgcctgcggtgatggcggggagtccggaaagatgattaacggctcgctgattgcgggaatttgtggcaggcgtactgatattatgccgataagaatgccggtgcggatcatgactagaatgcgcctgcaggaaactatttcgaggccctattggaggcccatgatgaccagatggtccgggtcctcgacgtgtcgcaacgtttccagcccaaggagaatctcgatggttaaaactgggccctccgcgtggcctggttggagcagaaagtaaagaaatactggatccacggctctgtatagatgcgaacgcatttccgttcgacgacgtgtcctgcgacgtagtatggttgcgcgaaatacctggtgattgagtttttggttgctgctgctcatgtgagggaaacgactctgcggataattgcggagatccagcccgcagcgctgcattagaatccgaaactctgctcttctcttggctttccgcagaagtattttccttttcactgaagggggagactttcttctcatcgcgcataggagaagctggaactcgaatatgagatttttcttgaactgaagcaagcgggaccgaagacctagattcactatcgagatgagttgggggggaagatcgtcgcgatgtagatgcagaaccctgaacagaagcatgtgcagacgaaactggctgcgaaggcgacggtgtatgtctcctggagatgctgtccggatagtgcttaggatatacttcacggcggattgggctccgtgaacgacgcagaagtgtgctattggattcactttcgtgaagagtgctttgtcttcgaggcggcgaagccctctggtacttatgcggtggaggtggggattgatctctcctaggagacctagatacatatccggttcgagacggatcacggaaaagtcttgaagaggacctggacggagactcccgtggggatcgctgtctatacggcgatttagagcgccaagaggacccgggaggagatcttggccgttctcgtcgtggtagatcctgtctcaaaggtgaacgtgttcttcgatacgggcgatacggagggctgcgagaagcgcgacgcgaagacacaggtgaccgactccgtgctcgattagaatgacggttgttatgcggtacccatgtatcagcgacttgacgaggagatcgattgcgaggcggagaccgagcacgccgaacatggctgcgagaacgtgagcgacctgttctctctgatgggcgataactctctccacctcgacgatcatcgaatctgacatgtaaaactcacattagtgtttgttctgaaaaaaaaaaagtatcgagaaaatgggttcagaaaatttgaacaccagaagacgaaccttctaccgcggtcacgatccattatcatattgcaaagggatccgggacgatgcaaagtatgcgagggacaaacccgatgagtgtgtaaaggtaatcggtaattctctcatgtgaatcagctcttgatccgtttgggaatatcacaggtgcaaacggacagtcaataaatttccagcaagtactctgtacctaggtacggagtacctatgagtaaatggccatgacgttgaactccgcagattaggcttaactatttatggcttaggtgatctgtgtccggagcgggtcctgtggcgggccctgtggcgggccctctcactccatactaaggtaggtactaggactgtatggaactaaagaaggtaggaggtatctacggaatatactctgtacggagttgcatgctaaccctggattattatattgatggaactgttgggatgtttccccttctggtcagtctggtgccctcacttgagtcacttcacttggagccctagtcatgaatattttcaaagtacctactcctagaaatcaaggtttctcctttcgtaaataatgtcatgctagtatgagtgtgtctagactcttagcttcctatttacctacctatgggtatcagaaactagagaaacagcaggtacctacctaaggtatctacctctaaagcttcagcaatagtaatagtacgttaagataacgccagttaaaagagtagccggaacctcagataagccttctattctagtacttaggtgccagggttaaatccttgaagcagactgtcttcatctcaggacatgtgctatggatacaagacgattgtgtgtatcaatacatcaaaataaaaaacagtaatgggaataaagaaaacgttttttattttatttcttcctgccccatcataagatccctagcaatggccatatcagcgcttactgcgtttttcttcctcttttcgcagtcttttgcggctctcgtttgcaatcatatcgctgaggtcttcctgaaagccccagttcgaatgctcctgctgtttctcttgatcatataaactctgaagcttctccttgctaattccatcatgactctgcaacatgtcgggatccattgacacgtcaacatcgccgggcttcttccgtttgcgggtctcctcatcagctccaaggactggaatattattctcaacagccttgagatcatatactctatcaccgccgaaaaatccctggactcgagacttctgttctggtattacttgataggcggtcttgggctgcgtagattcttcggtttccgttccccgatgatgtttgcgaacatcgaactccccagaaacactctctgccgttccaaactcagaaggcaccgtggacacaataccactcggtgtctccagaccgctaggcgtctgcaaaccttcaccaatatcctcttcttcggcttcttcttcctcttcactttcttcttctgactcttcctcaggtggctgcaactcaccccagagatccttctcaacaggctctccttgttgcacattttgctgagtctggaggacaccaaaaatgtcaccaccatatagaggtctgttgtgttcatcaactgggggctttccatatccacctgggtgatacccccaactcgcaccagggggtggaggtgcattgagtcctgggattttaagtgcaggataggaaggtggagggccgaacctttgctgattgatcagccaaggtggtggtgcccctggtggcatattaagcgcctccttcaactcatcgctgagttcgccaggtcgcaggtgccgaaggttggtttcatattccttgccttcgtaatagacctctccatagcgggtcagttccggcttggtctggaatcggaaaaaagcctcatatagtttttgatagtcaatgtctagtctacccatcttaggctgaaccctctctctttgcttctgttttaaagtcgcctgttcttgtttctccagagccgcatcacgcatttctgaaatgccagtctcttggatgaattttgggagagcaaatggcggcttctccacaccacgcttggaggagagatattctcgcttcaatgaccagtgagcagggacaggaactacgttcctatatgccttgatatggacgagaagccgtggatctgaagctgacgtgtccgtccactcgactatttctggctttcgaaccaaggcctttagttctgccactgatatcttattcatttcttttcgctttttcttagacaactttggcgccttctcttcctcttcatctgggatttcatcgtcatcgtcaaagtagacctgaggcttctcgggttctttatccaaggtctccccagcaccgggttcgaatttgctaataacatccttgtacatttcccacaaggtatcatctgtttctagagggagactaggtattgagtgatcgtcgtccgtgtcgggattggatatcgatgtttcagtcttgctagactcgctttcagacggattattcctcgactcatctgcagcctgtgaaccttgtcagcacatataactttcagtgtaaagtagtataagcttacagcatgtcttttggcttttcttcttgctctcttgagctggtttttagtgagctttggcgctacagccggcatattgccaagatagctggatagtgtggtacaatgatacagtagtagttgctggaagtttctgcagtcgagaaggatagaagcaagtggtaattaagaaatgatttcactaggagcaaaaagcgccttcttaataagtggttggatgataccgaaatattcatttcaggagggtaccatcagcatgtcagttcccgttgcagtcacgtgatttcatttgaaaacccagtacaatatctacctatgcaacctaagtgatgctatcacaaaacaggaatccgttcgtaagatacagtatattgactaagggaataagatgtgagattgaatgccatatttgagctgcagaaaaaaaattgtataccagtctccggcagaccgtcgacaattccatcccccagcgctcaccatggtgtatggaaacatttgctagaaaccgatcacgtagttgaaatgttgtacatcgataagataatgttgaccttcacttcttcttctttgccgatctcgattcttaaagagcgttagagttaaaatgacaagtccatatcaactctgagcattgggaaacaaatacctgcagctgttctcttcttttttggcctgccctttcctcgtaacttcgcactggataattaatcattagcatgctatagataagcggcaagatgccatctctcatacatttgaattgcttcctctcggtcatcttccgcttcatcaaagatcgtaagtcccagaggccgataagtctcttgtaggtcacggaatgagacagttttcctgggataccatgcagcaagtgctggtccacgcaatcgttgtcgcaaaaccttattccccagccgcagctgctgtggattgaaagtcgcagagaaaatccggcattgagcctagcgagaactgtcttagcaatgtcttctgagaaaatattctcaatatgtaacattgagcaaaccttcacaagatccagtattcgggacttagacgccatgataggaaagagtgtggaagcccgtaaccccgggtttggccaagtcaaattatactccgtaaggtctttgcaggctccgtaaaatcagaggataatgccatcacgtgatataattatggagtagcaaatggcaagcacacactccattagattacctttgttaacgcaatatgtccttctgaatagttttctatgaatatgggttctaagaggagccatccacaaatcgattcgaatgatatctcatctagtaaagaaaagagaatcaaggtgagtacatcctactgatgtcccaatgttgactaccgtctgatcgatttaggttgatcgcaatgcagtaaacataaaaagctcttgtttacgcgccgatagtgaagaacctcaaaatcaggctaaggatcttcttgcacagttagaggagctttctggagagctcttgaaccatccacaagcgcttcaagattatcttggagaggccggtggttccgacatcataaaggcagcaaggcagctgcagaaagcgattagtcaagccaccgtggctcaggtttcagattgttcaattacctctcccaagacttgcaatgacgccctgcggacaactgaaacatctaatttgcctcgtcttcctccagttcatgacacttcacttgagcatgcagtgtttacacatccaggcgtggtcaagaattgcagtgcacaaccatcgagggaagtcagttatgacagattggaaatcctcggtgatgcctatgtggaaacaattgcgactaggcttatttgggatcgttttcccggcctttcctctgggcgtatgtcgcaagtccgcgaagacttggtcaaaaatgaaacactcgctcattatgcagacttgtatggttttgacaagaaagttgccgtgccacaggatcataggagtcaaccaaagcggtggatgaaaaccaaagcagacgtttttgaggcctatgttgcggctgtgatattatcagatccagtaaatggttaccaggcggccgaaagctggttggtgcaattgtggatgccaaagctctctgaggtaaagcagacacaacaaacgctaaagtcaaaggaacttctagcaaagaaaattatgggcaaaggggtcaagctgaagtatgttgacgaacgaccaccagagcagatgaaaggaggtatgcaaacattcttcatcggtgtgtatctcacaggatgggggtggaataatcaacacttgggatcgggtcatggcctcaataaagcgattgctggagatgaagcagcccgccaagctcttctgaacaagccattgatagaccaaattgcggctgcaaaacatgcacatgataccagaattaagacgggctcattagagcatgtgggagagaattaagaagccgggacatagccctgggccctcaagtacccaccagctatctgacgaagaatatttacaccgagatgggttactacagccagattttgaccaagggagcttgggaccaaacaactgccctcttttaattaatactggattctgaagaaattgtggaatgcttgtagatttcaactatctactctatctgagatcacttttgtgctctgtggctaactaagcttttcttacttatcctttaggatctattagcatctattaggagttgttaggtaagggcagtaatatattattattattattattattattattattattcttccattttagagagcgtttttcagtcagagactatgcacgctctgcctaccacctaggcagtagggcttagtagctaatatctatatacaggtgggttatgctatagaccagtcaaacgctcataccacaatgtctatattatatcctggcctttaattttaaaatcagattatatataggtataactacttgtaagagaaatataaggttaatattatatatattgctttttagatacctattttttaattttacataaaaattacactgtattttatgttattccagtaaataatagagtagactacttctgattaatgctgtatgctgtaaatactttataattatagtatataaaatatctctttaatatctttaaagcttgttgaggtatgagcgtacaaaaaaacgcattttgtatggtattctagtgatcggagcaaccgggtgatcgaaacagccgggaaatacgttattagctacttagataagaggctttaaaaactctttaataaggataataataactctaatttatttaataatagtactaatactaacttagatttattagatataaccttaaaggttaatatagtattataaaaagaaagtaaggttatatagtaaaggtagtaagttatatgtagtagtaaaaaaaggggaagttataaataaatattattttttgttctataggtaatatagctttagggtattatatatatatatagggcggaaggtagttactataggttgatatagaaaggttgggagcagtgcacacaccagtgcaccataacaagaccttgtactatatacttatttctaaggataattataatgctctttagcctataggccctacctataagatagtaaactttataattatttatctagtcgcctagttttatctatatataatttagattagatagactacctgccacatactgacagtaggctcactgcctaatatgcaacctgctggctcttggctgattggccaacagacccaagtaggaaatcaatcaatcaatcaatcaatcaataatacttcataaataaatcatatatcctttaaagaatatccatgtcaaatcatgcatcactggctattcgctttggatgcttttttctcttcttcctaggactgataagttttggatccttgccttgccccaagctgctcttgccagctatatcatcatcatcaacccgtaaagcctcatctcgatattgagattgtgtgttagatgtctgttttttcttctttttcccttttttctttaccagagttccgtcagccggtatgccacgggcattaatgcgctccgatgctctttgcatttcgagccggagccgttccacttcctgcattgccctcatcatctcagcatcgtcctcttcctttccaggttcttgggcagtcattggttctaattgatcagactcgttgagtgaaaagtgcccaatccggcttgaatcgacctgcagaagacttcgtttgggtttgcctatgtcgtcgatctctcgactcctggtcgctgttgggggggatccatcgattccgaatgtctcgtcagtagctatctcaaccctttctgaacgcgaccggtgcttcttttccgtccgcccatcttcaatgaatatggaaaaacctttttgctcactgtcgatggccaaatcgataatgggtattgaatcaatgtcaagttcctcaccattcgaggcagtgaaaacttggtgtaaaggtgtagacctgcccgatgactcctcatcattcccaatgtagaaaggatcatctctattgcggtcccttcgttctaccccccgttttgcaatactgccgggctcttgaggtgagttttcaaaggtgtcttgatatgactgtgcacgctgttctgatttcagtgaggcttcacgctgactgctaaccgccgagctatctcgaatatagtaaaagtcttgaaagttttggtgatcaccaacatcaagccaggaactgttcggggcattgagggttatctggagcttatcattcatagcttgattcagatcaagattctcgggcaaaggaactttcttttgtgcatttatagcaacaggattcagctccagcccagaaaagagactggggatcacagatgtaagtaaaaacggcagttgtcgaaattcagaagaccgggggtttattgcttctttcgttaggcgcagaagttcgagaaactcaatcgttcgttcttgcacatccagatcaggatgagtcgccaacgcctcaagaaagctaataacccgcgtaagtaaaagagaacattcatttaggcgtgctgcattccagtcatggcaaccggaaatcagatgcaagaagaccttgggtatcgcttgaagataaagtgacagcgttctgccgggaagagatatgttatttgtagcgatcaaggtatgcagcgtacgatccggaaatgcaagaaattccgcatactctcccaccacccatgctgctggcccaagaatgccagctctggaagaactcatcatggacaaaggattggcgtggtcgtcaatagaaaggaatgactctgccgcccttgttgcttctaaccggacagatttcacacgaaccgccacattgcggatttccgccccgattcttgaggcaatgtccgcctcgcgcgcaacttggcccgatagctgctgatccaaatcggagaaactcccagtattcgatggaggtacaagtctcaccaactgtatcaaaatgttcacataccactcaaagtccactatatctgagtagttatcatgcgaacaaatgtcgaggattttgtggataacttcgttcctatactcattaggtaaagggggtgtatgatggatttttcgttcatggggctctaatgcttcccccatgccatcatagtcaacatcggccgacgatttcaaaccctccacaggtatcggattagcgacagaatttgagtcaagaacggaggaatgctgaagttgcgcaataagacgatcgacaacgagttgcagggtctcactagagaccatctgtacagccagttcgagagcttgtaggcgaatagagatatcggggtcatctagacagtccatgatcacgtcttgctgcattgccactagcgctgggtgcgataggacaattctgttgaacgcaagaagtgccacgtactttactgtacatgcgctgttagacttcgagtcaaaaaagttaaaagttgaaggagacttacgatttggatcagcatccatggctatcatgcctctcagcttcgctacacaaaggcttgcaacttcatccccttcttgaatgccttcagcttcgtcaagaattcctccttgaatgataccattgatacattcatagagtaaagacatagcagtggttgtttggatgatatttgttaaaggacgaaggagcttccgaaccaaacggggttctaagggcgtcagagtagcaaactggggaacttgatgttagttgatttcttgataggtattcagtcggtttctacttacaagttttattattttaatagccatccagttgttgccaccatcaacaagtaattcgaaaaacctgggtgccagagggaggaagtcacgcggccttctccaaccgagttcacatacaacattgatgacagcagctgtgacactgctgtcttcgtgggagtccattaaacgttctttaatttttggccatgccagcctcaatgcttcagggtaaactaaagcaagcctatagagactgacgaccgttttctttcgaacggttgcattcgagtgtgagaggcgcggtagaagatctgaaagtaaggacatggcaagagaaggcgtgataatgtgcggcagtgttgcaaggggcagtgaaagatttagcacagaagaagaaacaatgtcctatacactcgtcagatgatgaaggaatggcggagacgtgatatattcgaccgaccttcttcagaagatttgttgccaacatcaatacctctgtatctgctcgaaaactttgtgctgccgccagatagccaacccttttctgtaagtatttggcagaagacataacttcaagaacatgaaacgacgcccaagacatgtcgtatccgaacatttcgaggtatatgagtttcaatagagcggtcgtctttttgtctgctcgaaaatcagtcatcggtcaaatgatatgggggagagggcaggagaatagtgagaattgcgaacccatgtcctgtgacttaatttcaaccttgcattctttaaggctgttttgaatatactcgacctcattgcccctattgtttcgcagacctctgatgaggtcgtagagagatttttcgaacctgggaggtctcatgtcagcgtcatcacgggcaatggaagaatcaaagatcctacattgttaatgtgaatatgctgtgcctcacagagcaactgaggaaaataatattagtgccctaaacggtgataaacccatcaccaattaggcaatgctttctcatgccgaaatttaacaaatgtgactttctgggcatgtttttctatggtcccgcaatttcagtttgcgtctcgagagatcatacaaatgtatgcttcatcctcgcacaaaaagttctgccgctgtagctacttcggtattcgtctccaataatcggcaaaagtgggaatctcgggtgacagtgacatgtacggagtacttggggtgtataggtagctaaggattcggcagctctcactaaccttcctaggtagtagaggacttcactccggttggtcggacatcccattaagtagccttatgaataataatgagacactgtatatcttcctgttcctacctgaataatgataagcacgacatctaagtttggacacaagacataacacagtgtattttttttagttcattacatttccttcagttatttaacctaggcgaaatcaatagttactgactcattcggggagcgcttgtttaatcagtggtggttaagtaatccctgccgcatccgctacgagccactgctcatgattggttagcaatcggtcttgaagccgtatcatacggagtaggtaggcaaacaatgttaaactactattttcttcgaggtccataacttgtgtcagatcctcatgcttcagcaatggcgaatgttttaatgaattcggaccgcggtttggattcgttaaacccgggtgctgctcttcgtctatcccaagaagcttccgttttcttgaagaaatatcattatccgctgcctacttttcccttatcattggcctctgcttcagagaatccggacaaatggggcacttgcgagcagctattccttgcctgtctgcgtaccggtgatgacaaatctgcgcatctttgcttggatcgtctgactgaacgttttggtccttccaatgagaagatcatgggattaagaggtctctatcaggaagctactgcaaaggatgtggcttctttggagaaagtactctcagaatatgaaactattctatcagaaaatccagtgaatgtggtcagtttcgaaatttatgactagggttataggaaatgcatgctgaggatattattatagcctgtcctgaaacgtcgagtcgccattctgcgctcaatgtctagagaagaggatgccatctctgcattggtggagtttcttgaggccttcccaacagatgcagaagcctggtgtgaacttgcagacttgtaccagtctcagggcatgacctcacaagcgatatttagccttgaggaagcgcttcttataacgcccaattcctggaatgtatgtgcttccactttgacatctattaacagaatttatctaattcattctggcaaacagctgcatgcgcgtcttggggagctgttttacatctctgcgattgcgtcggattctaaggcagttttgccgggcctccttgccatgtctatacagtacttttgcaggagtattgaattgtgtgacgattatttgagaggtttatatggattgatactggtactttgcgccattgccttttgcccctctaccccaatttattttttcaattttcattttactactgatacacatcattattctgggttctctctttgactaatgcttaattctaggcctcctcgttcctcatcgagcatttgactgtccaacctttatctgcaaactattcaaccaatgcagagagtgtgccatcgaaggaagtggtcgagaagctgaacgatatggcgaaacaaaggctgcgcaagcttgtagagtccgaatttggggttcccgaagacgacgcagagaagcaagcagagctcatcgcagcacaagaactgctccatcgagagaaataattgtcactatcgttgtattcttcgtacatgcttacttaaaaaacaaacccttgctttacaatgccctttgtaacagtgagattccatgaaaatgcttaaaaagttcacacaggatttatgttctttgtacgattgtggtgatcactgttttagcgatgagctgctggttttgtacatgtgttctcatatggaaaactttttatacagcgtagttggctatctggtattactttctcactgtctggtcagggttattttgatactaagacatcttggctggtcctattaaattgcgagtgtaggcgccctggtctgtttatcgaggccctttggctatgagacggctaggaatttggtttgacaattatgtatctaaactaaacactggccatgaccgaacattatctctctattatgagacatataataaagaaaatattctaattctaagacataggacatattaaggtgtgtgtatgcaacaacattcaacccccacccctttctccttccttgccttccatcagaaaggagtgatttccaagtcctgtggcagtgcaaattatcttaggctgcctaggcctgcaataatacagcaaatgggaagaattaaatgacagcagctttgtgagcagctttatcaagccgccccagcaagtcgccatattgcatataaatactataaatactcttacggagtagaactcctttcactactattctcctggtggcctgtcagtttcaggccagaatttcgtctccttagtagtatggatcggaaagatggtgatttctttgtatgacactatgagagctgctttccaggggtgtctttggccgctgtaagtcaaatcaggctggtcatttttagccttccaaacaaacacttagagcaatcggtatcatctcatgtaaaagaactctttttatccaaagataaagccccttacatctactcctagttctaagttttcatgctatacccgaagcctaggactttcatcagtctccaagataattccgtaggagaccttcgaaagcttccattcctttcttttaacaacactaaattctgcatacttacctacctactaggtactagccactatcattaacacatgatgatcattggtcagatttcatactgtcaaaaattgcattattaagttctttgggcagcaagatggaatcagggcaacacaggcaatgacacagggttgttgctggctccatattattcacaaagctactaagtcaactactctgtgttttgaggtgctacctactattaataatctgatctgattaatgtaatgtacgtactaataatgggctaggaataggattcctttcccccctctgtgcctctgcccaactccacttaggccaacaacctctgatggtcaggcacgtaatgttttttttgttcccatcctgtcataaatctggccaaacaggaacacaaatcatattctttgcatctatccacatgtccaatgctctcctgttgagaagagctaactgatcatttcctcctctccaacattcataatctgaatataataacataactgcacatccactattgatgtctatttatccattacccagccacacttaatgttatatttcattccacttgttccccatccaattatgaagtttgggtgataaatttcctgttattgcttctgcttctgtctctatttcaatccctttgaaccgaagtgtttatcttcagtgtacttgtgaagcctccaagtgaacaagagtcgtggatcggacatttatcctcagaaataacccttttctatagtttctgaacaggagaggcgctaagagctcctacaagaatttctgcgccattatccatgacgtaagtaccgaactgaatgaaactttgctgatgaatcttgctaatcaatggctgcatcaggtttaacatcacaattgatcatacaagttctcacgactcagataattcgtctctaagcgacgaggactcctcgggtgttcaggtctcgccgccgtcaattactggtagtcacgattatcaagactcgtatgatgttggaggcgaatgggcgcatttgccgtatcctgatgagataaagccgtccgattcagcctctagaccaaggacatcacgccatactcgccatacaattcataattctcgatccagatcaagtcgtcgttattcgaggcgcgatatactcccggagcgggaatcgctctcccagaggccaaggcgccaccattctcccgagtctcctgaaagtgtggactcggatgaagaatttgtgggcacttacgcgcggccgccaccagacaggcgctactggtcatctgtcgctccgaggccagttggcggatatgcacacagctcgtcttcaggaccctcctacaatgtttatcaccatggtggcattcctcatggccctttcggacatcccggagggtctcatcctccttctgaccaactggtaaggtttggtcacctgggacatccaggcagttctacacaatacgggaacccgtcaccttatggatatggtccaccatatcctcacacacacacagctcctgtacctcccttttttggtcatgatcatcattctggacactcagcacatcacttgcatcagcaaccgcagcctcgaaatcggagcggtgggcatagcccgccccagccgccgccgccacatccggtaccttctcatggcaatcctccttatggaggctcaccattcagtcccccagatctcataacgtatggcgccggaggttatttctacaaccaagcctatccggtagttcctggtgggatggttcctccgcagtactttggccaattcccgcatttgtcgtctccgccccagaagtctaccactccaccaccatcacaatcagacacggccaaagacgaagccattgcaagactggagaagttaatcctagatgagcggacagaacgagaggcaagagaagctgcgcgcgaggcggccctcgaaaaagctgctgcggaaaaggctgccgcagaagaacgggctgctgcggagaagaaaatagctgaagaagcggcagcgaaggccaaggcagaagcagagaaaaaggctgctgaagatattgctaaagcaaagaaagaagcagaagaagctgcgaagaaagcagcagaagaagctgctgccgctgcagcggcggaggcagcagcggcggcagcagcagcagcgaataaccctcctccggaaaagaagaaacctatcaaattcaaggacgctgttggcaggaaatttagtttcccttttcacttgtgcaagacgtggcaggtaagttctgtgtcctcttaaatactggaaggccgtgtctcattcttatctgtgctgtcgacaggggatggaagagcttattcgtcaagcttttcttcatgtcgaggttataggaccacacgttgctgaagggcattatgacctagttggaccgaacggtgatatcatacttccacaggtttgggaaactgtgatagaacctgattggaccataacgatgcacatgtggccaataccagagaagccaaaggatcctgaccctcctccacctccgccgccggcggcgccggctcctgaagaaaatgctaccgtcgaggagccgaagaaaaagccagacggagcaggtatgttcaatctctttccttatcgggtcttatcttcttctttcccatttgatttggttaggttagggaaattctattgactcttccttcaagtagcttcaggtcccaagaaatcacgacctcgagggcccgatcctggatccttcgcgatgtggatggccggtagcaaccgggcaaagttaaacaagactttaaaagtggaaaaaaagcctgaaattgtgcagcaacacggcgacacttgcggtgttatgtgagcgagttgagggcctaattgccggaaattagttccgaacaacaattggagacaaattggacttggcaatggttttcggacggatgcctctgaggaatatttctgatcgaggaataaatctcggtctctatctcttcgggaaggatcttccttcggtgactcagatagttttccgtcttgcggcccttaccgctacatggcacatttcaggaggcatggcttttcctctcgacgtggtcgggattggtttctcatgtctcatatataccagccttgtcggctagaaaatatcaggggaattttaagcagaagtcgatgctttctcccccctttagtatttggaggagaggttttcaacttggccgatggaagggcatgttaaagtatgttccttgactagtattgggtaatgttagatttaagattttatttcacaattgatacccttagaaggaatttgttggatggtcatgaagaattgcccggaagccggccttgttatgattgtgattatcttttcttactgctgtaatcgttctgttctctttcttttaagagcaaagaaaagaaggcactggcagtgtttgccgatgccgtgtcatttaaattacatattagtattagagtacatacatacaattcaactcgaattacggtaaaccttctgacgcgatgcatgcagatttgaggttgaatacttcagatggtctccagtcgaaatctctagtcgaggtctctaggtagttttagtaatctgcctacagaccattcaacaattatcttacaagaggggaacaatgaaggataacagttcgcaacatcacaaaaccctgtatatgatttgcttttgggcgttcttgggggcttcattttatgcgttcattataattcttgtgtcggtggagttagatgtggaacatactacacggcgacattagatacgtaagttagatcaggtctggattcatcgccatcataatcataatcaaagaaaaaaaattattcgcatgattgttgaacgctgagctgaaataacacggctcttctggagggagaacccgccgtttgatctaaattatgatcaaagtcactggaatttattgacaatgtcaatctgtccctcgacgtggaatgagaggcttccagtccttcatagcttcatccgctccatcatcaagaaaatttctcaacggaccttcatgtccaccaggtaggtgagaagtcttattgacttccatctcgttgggggattcaagacccgtgcctttccgccacggctgacattcaagtctctcgtttggggaagaagatgcaggtttgctgttgactctagcgggaagaggaggtctgtaggtgtgagtttcctccaacctctcgtgatggtttcgtgtgtcatgatttcgaaattcggacgagatgtcggatttattcgagttcatttggaggctcaatgaaactggctttctaggtattgggggtggcagctctcttgggtttaaatcacccggtttctgtgaagatacacttctatcattcgaagagttctgcttggtctgtgtgtcactttccaatggcgttgtctgtatggtactggacttcgcaagccgtctaggaactggaggcttcggtggagttttcactggaagtgacgaccggttgaagtcctgcccaccattttcttccgatgattgttgcaacgtgatccagtcaggttcagcacttggagaaaagggatttgattttcgatatatgttgggaatttgtccatgctccgggggcttaattgtcgacctcacatgcgaacctgatttctgtcagccaactgtgtgttttagtatgaactatgtcttctggatctataccctggtcaagccaccatttgtgacgatctgaactggccggagggaaccctggtgcaatagatcgataaccaataagctcctcgtcttcactatcctcgacagtgaatttcaacgtcaagtcgcctatttcacggcggtgcttatcgtaaagaacgcgactgagtcgatccttggtttgctcgtcaacaatacttatcgtgcaatcaaacagagcgaatacaggacgatgatctgagaatttcaggtctgccgtgcggtaatgcctttgcctgaggtttgcccctttccaaagtatccgatcacaccacgcaggtatacgagctttttctctggaaagaagttagagctgcttagactggatacagtggtatatcttacgatgtatcgtattcatcagtgcctatgttgtacttataagttggagggaatccgatacggccttcagagtagaactgaaatgttctacctgcgatcatttgtaggttcaactatgaaaatatcagcatttcaaagtttatttttgagaacggactgaattacctgatcattctcgtacagcttgtcgtattgcttcttttgtatcagttctcttactttctggtcgctaaggcctatgcgataattgaaatcgcccaaccatatgatcgcgtcgtgatcttcaatggacttgtttttctgaaatctcagaccgtggcttattgttgcgtagtctctgttcctttcgtcatagttcgcaaatccagcggcaagatgagctgtgacgaagcacagtttcgtattcgacagttcgagacggatggcacatccgcccttattgcccgccattccggaaaggccagtcttcatcatataatatatgttagcaggttgagtaaaggtcattgggaatgaaagcctgccttcttcacacttccttccacgttcttcacatccccaagagcatcggccctgatatatattagaagagcagcgccaacaagctgtccacttcttaggaggacatatttgcttcttttaaatcgttctgaataggagttcaaacacctcttgactgcttcttcccacacaaggcgtggtttaggatctgtagacattatttgttgtggactgagttccacaatttcttgaaacgcaacagcgacaattgttggatcttctccatcttcctcacgcagcgcaagaagccatggagaaagatcagcggtagcaccctcgcttcttccattcaaattgaaagttccagcccatattcgtatatttctcacagacgtgtattctgcgactcgtcggttgagctctgcagtgaccatatcgtttataggatcatacagatcaacagatacttggttcgccaaacgccctagtaagatgtctatggtgttctgtctggccttatctgcaaatgtgttcacgtacaagcgtgttgcactcttccgtacatctgcaaatgcaccagcaagtgacattttaccgtgccttgtgaaggatgacttcagcgcgccagtgccggcatatattttggacagagcatctccattatctgcccagagacttgaatgtctcatttgaagatccgggaccatatgccctccctgttgaaacaaaaaagactctagagccatctgactgattattgtctgcacgagatttgttctatcgagacaatcaagacaattggtccgaaatatgccttcttgttgtaatataactgttgatcccttctctttgcacttctcatctgacttggaagtttgggggccgacaccctcatccgatagaaagtacgcaaatccatccaatgagtgctcgatgatatgtcgaatctgactgctgccttcgtaacccagtgggccgcgtgtctccgcatggaaatcaaattcagtggtcttcaaaagatgatgtctgacttgcgaagtagcatcattctgttgtctgagagatctcctcgcaacgtgttctcggaatcgcgccgacaactcagattccccaggttttgtctcactgagaagatttataatgtgtacggctccgtattttagttcaagagtctcgaaatgcttatcaaaagcatgctgcgtggcctcaaaagacctggcaatttctatcttttgctgtccagggagaagaccggctgtttgctcccaaaaaattggcactgacccgcgtgcttgcgtgtaagaaaaagttatgcctggggggatccataaaacagtttcggtttcgacaaaatttgaaacattcccgtcatcgtcaataccacgggaattgaaccttgtacccgcacgccgagaagacaaacgtgagatgacagttatatttgagggaagatttgaccgcagttgaggtaagagagagatggaagcaggtatcgttaaggttccagcaaatcctctaataaccgacgttaaaatgtgcgatgaatcaaggttcgctctttcatgggtcgtcagacgtctacgaaaaagcaacagaggacgaatcatgtaagagttccacagcatatcttcatcgagactgtcgatgtcgaaggttcctgaatcattgtatctgagatagggttagccagctgcggccaatagcaagggtatggttcacttaccgattctggagacgatctgtgaggttgaaatcggggctgtaatagaagctaccatcatttaagagcctttttaaggctaaaaaagggtgatccgtgacaatatctttattgtcataaatgccatcgtggttgatctcttccgtagcaaatcgagaagctaactggtagtcctcgctatgctcataatccgatcgattaagacagtctatatccacattaacgcaatttccgaagagcttcaagggtaattggggccacatacaaaattcgacattgtcgatcctcaaaattgtttcccctggtcgaactgtcgcggccctagatgatgcagtcacaacgcagataaaaacatcattgtttaaggtgatgagaccaagagtcccatatccctctcccaatagtctgtagtctcgcaaatccaccgacgaaaggctggagaagtccaccaggcagcgcggcacatcgccatggttgcttgcacctctggacggatctatagtcgtcgaagtatgactaaggagcaatacagacttgtttgtagctagagcgattgtacgacgaggttgatctcgacagagaacgcgcagagtagacattgcctggttagaccatcactactgccagattttcatctttcaatgtatgtgttatatggagacaatcctttttggagattacagcattcgcggatgctgcagatattgtgtcgtcagcaaaaaggaggtgaattcgatgtgggaacttgcacattcattgaaattaactgcagagagcaatgattaaccagcgaatgacatgaagaatattattatcgttatattggctgtccaatttgcatagcccgggtagcttggccctgacgtactatttcgggctaacaggaacctccattattgatgctgactcagcgcgtttgtccgcaaaaaaaaaagttcctgtcgccccaactggtttacggagtaaagaaaattgggtatattgttcaccaacttctggcaggaagggtcagcactgtatttactgtcagcccatcctatctctttaaccttctctgctagaacgaacaaagagaaggtgccctccaaatgggcctggcagaacctcgcaagtaaggcgattataacagcatgatctccgcgtctcgctaatcaccaggagaataggaaaatcaagatatcgcacgacccgaataatactatctgggctcgatcgacaagtggatttggttataagattttaacctctcaggggtggactcctggtagcttcttaggcgcacgcaacgcagcgcacgctgataccttcactgccgccagcgcatctcatatccgagtgacccttaaggatgatacccttggtttaggcgctcgtcctcgaggaactgcagatttcgagcctactgggcttgatgcattccaagggctgctggggcgactcaacggaaagagtgacgcggagttggaaagagagcagcgacaacgagatgatgcgaggctggcactttatgccgcgaaaaagtggcaggcggttagattcataagcgggggatttttggtccaggagaaacacgagcctcttgctgcagaaagcaacgccaaggacgctagaaaggagccgtgtcatgaagacaagacacagaaactggaaggagataccggcatggcaagtgtcaatgctgagccaccgggatctgtttgccaggtagctgccgagtgtgacggatccaagcaggaagtcgtggatgatgtttcatgtacagccgccacaaagaagaaaaaagagaaatccaagaagcggaaacggatatcttccgattctaatgataaagccgaaactcgaaaagatcgttgtcaatctcctgatcgtgtccattcgaatgagcgagccgcaggatcattgtcccaaacagcgactaagccgagagaacagatacctatgggcaggcatgttataaggagtcgtcacattcaacagaagaaaagggcgctcatggatgacaaatctctcaacgaggtgagtatccggtccctatataagtaataattatttcttatctcttttggttcgtgaactgattttggctagatattcatggcacaacgctgctattctagcacaggaaaaccacgatctccgtatggcaaacgagaaagagaagcagaaacgagggcgatcaaggcgccagatgtctcctaatcaaggcctttctgtacaggaagcgagagatctcatacaccagagaaacgagcaaggagatgagatacaggagatagctatgggttctgcatctctaccttccaacgcgccaagacgtgctccaccaacatgttctaattgccatattcagggacatattagaactggttgtcctacacgtctaaatatatagaactcaatgaaatacacgtgttttggttgttgtgtatagcttcaagttttcgaccgcggtcagaattcgatgttggtgtccggttcggtcgggtgtccggttcggttgggaattacgttaactaactagttagttagttagttaactaacacttgattggtcacaatgtcttagtcagcacaattacgcgcctgcctgccttaggtatctatcttccacactctatgagttgcacttccctataggctttacgttggcttccctatatacgccttatataggcttacttgcaggcatgcggagggctgaaggtccgaagcctttaggtataaggcttaggagtagtttactatacgcttttggggagtagtaataggtattcgtataccccatattcgtggggtaaggcttattatgagccaacgtaatcttactccgaatacggagtataatactttgcaagccacatgagcaaattgaaggcttttctcgtacgtgcgaaataataataagctcggaccctcgcagctgccgcgtgaactaatctccgaggcagcaatctgattggtccgggcgagaccattccaaggctaaggtattggctccttccaaattagatcggtttagcctgtttaggtgcttctcaattatcagattggcctcagttcagggacacgccggaataccacggagtagtgaacaattaccgcaagccacaagaccggtttgggcgacgcgtcctctttcgtcaactcctggggagtttgctcccccctggggcactccaaaagctggccagcgatggcgttattctggctaataataattaaaccgcagcagggcctctccgcgacgtaagcatgcattaactactgattgaacccccccaccttccaaccgtgctattcctgcgcaatgtcgtgcgtctacagagtactaggtcgcttgaatgcccagcttcggtgggcccaggggactcgaagaggctaagatttttttttaacccctgctttcatgttggaatcttcactgtcagctgcgcctggcattctcgatcggcagacttggccccttgcgggggtctcccagatatgtgggagctggaacgaaggttgcggggcaagcgaaagcttctgctcacactgaagccgctatgcgccatcatcgcgctgttgagcattctcttctttcttcgaggagacgagtggtactccccgggagccggagtgttgctccgaggcagtcaggtatgcaacccccaagatgatctgcacgcgggcagctagctaaaggccgtcccagatccccggttcagatgactttgatttcaccgaattcgatttcgagcaacgagacaatagccatcccatcgcgggtttgataagagaggcggacgagaagtggctgcgatatgaggaggatcggtccaggacgtttcgagagactgtcgccaaataccgaaagaaatacggacgccatcccccgccaggcttcaaagaggtatgtctcatcagcgagcgctgcttatggtcccgatttttaagaattgtccgtatctcagtggtatatctacgcgcgcaagcgaaatgtccacaacatcgacgacttcgaccagatcatggacgatctacgcccattctgggcggtcgatcccaaggtcatccggaagatggctgccaagctgtctgagaacgaggcagacggagtatcgggcgtgcacatccgcaacaagagggtctctttcctgacgaacaagagctggcgttcggaggcgatggcgaaactcatttccccttttgtgaagtatctgccggacatggatatcgcaatcaatgtgctggaccagccccggctggtcgttcctttcgaagatatgcaggcgctcttaactgcggaagtagagtcccggcagatgatccccgatacgattgacagtttcaccaagggcatggagttctttcgcgacaagcacaaggcgccgggagactgggacgatgcgactaacccagaatggtttccctacccttcaaagcagtacatggatatagcgacgcccgcatgcccaccggaatcgccggcgcggaattcgtccatcacgatcgtcgaagcggacgctctgtacaagtcgaaattgggcggtttggtaacgaatttcaatctctcttcagatctgtgcacggtgggaccagcactgcaggacaagcatggctttctctactcggcgtccacgatcattgcgtcgaagcgtctgcttccgatcttcagcgagtgcaaggtcagcgtcaacaacgacattctcttcccggccagcatgtatacgctccgggacaagcgttacgtctataatgcaagacacgactgggcgtgggggcgcaaggccgatactcttatctggcgcggcgtcacatcgggcggcgtgcagcgggcggacaactggcaaaacatgcaccggcaacgcctggtccggctcgccaatgggacgttcatgcgcgaccaggaggtgactatcctgagcgaagctctgcaccgcgagggcgagtatcgaaacttcgaccacttccagccgtcgtggttcgcaaacaagcatttcgacgtgggcttcaccgagtcgtggggctgcatcccaaactgctcgttctacgacgacgtgttcacgtacaagccacgggtgtcgctctcggagcagttcaagaaccggtacctggtggacgtggacgggcacagcttttcgggccggtggcgggcattcctgcagagcaagtcgctgggcatcaaggcgaccattttccgtgaatggcacgactcgcgactgttcgcatggcggcacttcatcccgctggacaaccgctacgacgacctgtacacgatcatgacctacctgatcggcacaggccgtccaggcttcgaccgcgagccggaggacaactacgcgaacgcagacgcgtacgtgcgcccgcacgatttcgaggcgaggctgatcgccgcgcagagccgcgactgggcgcaccgggtcctccgcagggaggacatggagatctacgtgttccggctactgctcgagtacggacggatcatcgacgacaaccgcgacgagatcggatacagcggcgacggcagcgagctggacgagtttgaccggaagcatccgatcccggagatcccggacatattcaaatggaggagcgagaatgcttcaccataatcctaataataataataatgaaaataatgaaaaataataatgagaaccaccagagcttggtcaagaagaccaagttggacgactacggtcctcactgactcggtggttatcatcatcatatgatgatgataatgaactctcaacagtcacaaatacttgtactgtacatatgtatgtacatgtaatatatcatgcctgtatatccctgtatcatagccattattgcatacatattgaataattgaactgtttatccctcgccttcgtcagtatactcttgttattaataaaacaatgatataataatacaaatgcgtccggaattctggactactgttcctgatcaggcgctctcttattacctgtttactgcaagtctcgtcatttcgtaacagtccaagatttagcctcagttccactaccagaatacttcgaagattaggcaatcctgtttaatgccgatgcacgtcacgtgtgacgattcgagccatcacgagattcccattctatttctcatcccatttagcaataaccaattatcccaaccacccaaaaaccacagaaacgcctccgaatgcaaattcccatagataatgcaacatgccgcctgagtctcaatcgatacaagtcacaggctcaaaaagaatgcacagacagactgtctagacgccatagcccatgcaaagagttttttttaaaccaagtaaatcaagccccgcatagtccgccagaaatcgaaacaaaacatagtaatatcctgaacaaaatgataaatcatgatgaaaacccgtctatgctgtgacaaatgcagccgcctcgtcaagatctctcgaaaaagagaagaggaaaggagaggaaaggaaaggaaaggaagtgatatcctatacagaggtgggaacaatgtcaagagtgcacttcaggtggagtacgtctgactaggaagaaagttcggctgcgcaatcggcccctgtggccatgcctcctgatgaacatatggcagcacacccgtcctccgttcagacacactcttgccaagtggctggtaatgcatctggtccacagacaggttccgcggctgatgaagagatgtcgacggcggaggaatcaggagcgtattgaccgcacgaacaggccgatacggcgagtgccggttgaccaagaaaaacgacggtgagagatggttctgagaggtgtgggcagtaaaggaggaggaaggagagatggtactcgtcgaggtggtcacggggaatggactctggcgccgtccagcatcggagactgagaccgccgggttgtacaaaggagcagccgtgggtacgggtgccgcggtcgtcgttgttgcaggtatctgctgttgaggccacgtcgtcggggggttgtagaccgaagacatggcccgcacgttgggcagagggagctgagaaacagtaggcggcggcggcacggcagtcgggaccatggaggtcgagggaggttgatagttgttgggtcggggaagacggggagcaggcacagcgatggttggcaccggcatcgtgcccgtgctcacgactggcggcagcacgggaacggccgtgctcgcaggagccatcgtgcaaaccggagccgaataggtgttgttcgacacggccacgcgcttgctgggatgctcctcgcctgcgtcatcccaactgcgcttccgagaagacggcggcagctccatctccggcaattgtcggggaggtgttcggccccggtaagacgtgccattgggcaccggattccaggtctgttgggtttgcagatgactggtagccggaggggatggcagcttggatgcgttcagtatgtgactgtggtcaagccatgatgatccctcacttcctgatataggagatgccggggaggcagtcaaaccaacaacggctgctcggtcttgtccggcacagcaatcctattaggccagggttgccggttatccatcaggataagtgcctatcttttaagactcggaagaaagggcctttctcacgaccggagcagattttggcaatctttgtcatacatcgataataagactaacccggtgtcttatgctccatcatctgcatcactcacataaagccaccggacgtccagcgcaagggacactcgttccacctccccggacactatctacagctaaccgtacagcctggtcgcctcgccttctcttcagtgcacctcattattatacatcataagtcctctcatcgccaactctcattgatttaactaccacggaagctacttgccacagaaacaatgtctgtcaaaatcagtgcttcttccaggggagacatgacaaaacaggactgtccaagtccaggtatcactctttaaccagtgcgcttagataggatccaccatcaaagtaagaaacaagcaggccaagcaagacagatccatgctcattaaaacatgaccagacacgagatccatttcaagtatctaacgggccacgttctggcgtcttaggtaaggtcatcactgataaagtccaaaatctcagcgtctttgtatagaagaggtgaatagtgcctgtatttccgcagaaagctgatcgcctttcctagacggtcggcaagttcgtatttatcaaaaccatagcgtggccaatccttctgcagagagagaaccgacaggatcattccaaactgcctacaaagagttttagaaaaaaagcaacatgatgagggaatgaatagaggtgcacctacatatgaaggaaaccaacaaggttgggaaaggtcagctctggctttcccatctgacgatccataatatcaaaaaatctccatgccgtactgatgcattcgttggcttgtatgtcaacctcccaatatgtgtctggatctccaggaggccccgaatgaacatactggtggacaaaaggaaaacgggcgtgatgctggacgtaaaagtatctcaggcaaagaattgcggtaaatgaatccgagggaggaggtgattcgtcattttcgatccatttagtccaagtgggttgtttggccttccaagactctaattccttgaggatggtgtccatctgttctcgcgctgttgccttagcagagtccttattgtgctggcattgaagtgagaactgtatcagagcaagatttgccgactggtaacaaagcatgatttctttgtattttggattaacaaatccttgccaatgttccagtgatggaaacacttcagtagctatagtatcgaagtattcagaaattccgctgcgaggaatttctagtacagtcgagatatctctgcatgacaatcagtcagagtcgtttgagacctagacaggcaaatacctttccaacattacacaggtgaggaacgcgcacttgacaagcagagttctttcctgcgattctgttccagacacaaccctgaacgagttagtacaagcccagcagtaggcatttatatgctcacttcctcatcaatggcatacaaccctggcaagcccgtaatatgtggccatgcctgattgaaaggagcataatctgatcggcgtagagcgctatgagcagatgtatctggaccttatgaagtgggtcgatatctgtcatgatgcgaaaaatttcgagggccagtacaaaatactttagcccaggtattgcctcaatgttctgtcgtactgcgcttgcgatctctgtttctgtccatccttcaaatggctctacttgaggcactggaaggggctcttgcctactggcaatactccccaaagcaacaacaagaagaacaataacatctgaattggtataaaccagagggtaatgtttatccagcaaacatttcctcatcatgctcaagatcgctggttcgaggaaggggtattgacagtgtattgtccttaaatactgaatgcaaaggtgggagcacagcggatcctggataggaatttagtagtagtcgaataacgtaatgttcagagtaatgcttggattatcttcaattccataccatgatgccttccgccagtgttcgcttctctttgcataatcttgagtgtactgtccttggattaatcgttccaaaagagggcactcaacaagatcatggaggcgaatgatggactcctcggaagaaccatctgtaaatagagattgatctgccatcctgagaggcacgtttcacccgtatcgatatacacaagatactacagggtacaagattaatgatgagagcactaaaatgtatggatagtatttggaagcatcggaggctatttaactggctcggcgaatcgagcgtcatgtgactgactcagacgcgtgcattggaaacgcgccacagattgctcatcaattagctcttccgcaggtgtgcgcaaccactccggccaagttgactcgtagtgcggcggccgccaacatttccctttgctcatagtccagtgcgagatacagatctttttccttctcaaagttttccactttgttttttagaaacttttcttggtcttttgcatttgcaggcccatttgggaacttctcgttgtaacgactcgcgagccaattctgattcattcagtaaaagtcccagcgttggatgatcgaagactcacaaggaaagtctgatgatcctgccctagccaccgctttattctgtctatgtcttgctaaggagaaaataagtgctgttccttctactaattcatggggtttccttacccgaatcgaacatcccccgcagtttatgatctgtgccattgtcatttaccgtcgttgcagcgtctactgagaatgcgatatttatggatctcagctttcgattctatctctacgatctactcgtccatatatacttggaaggatcaaggcgctgctacgctgtcagtttggcttatgcacctgtgccgagtagctattgggaatctgcagttgccaaccggccgacgatccctgagaatgattcaaaggccacagaagacgcaaacggagctggatacttgcgtcagatgggtggcttctccctgccggctgcggcaccctcttgcataaggtttcgatgaccatctctgcagaatctgtcgtaggagcagatccctgtcccatatctatatggtgcatcgatgcggttatcaaatggcttgtgtgccaatgttcatcgaaggtccaaatgccatcatatcatcgcttgttttgttcaacaaggatttatcatgtttctacaaacatgaacgacaaaaaacaaagagaccacttgttcagatacgatattgtgggaaagcataaagatggtctgactacttagcagagattctcccggccttcccctaaaataaacttttaaccgctattgtacagtgtcttcacgctgtgtgatatacagagaactacgagtcgcagactgggagctaccagctgcaacgcgatatgaacagagaatggttagaagattactcgagtaagataatacagtaatcccagtatgtgaaattagattatggattttttttttagctaatggcaagatgttgataccgctcagccatccacatcatgtgatgcagactaggagctacataggggatacatttaacgaactgatgtcatgtactgtactgtcatacttgcttttgatcgcgttccagtacatctctgattagacattctgggcaacgctcatgaccacacacattacaatgtcttcctgatgcatttttctctttgcatacgcagcaataaagtctcctgcgcatacgagcatccctttgcacccatttttgagctagaccttcgactttccgtggttgctggggttcagcagagtctagaatcttcccaaatttaatatagcttccttgatgaggtatatttcggtcaattggttgacccggccatagttcagttttgctgaagatctgtgtttcattatgattgcttgtcccttctgctgctgattcatgtaatggccgcttctgaggctcaagctcttccctcatggcagtagtgcttctgcgcttcctgggttgagtaggaaaagcatccatcccactgtggcccgttttgcaatttcagaaaacaatttctatatccttgaatcagtctgtgacggcgtttatatcacaaaggtagagactcacttgaagcgataattggacagtaatgtatctgattttctgatgatgcagaacctagttgtatacctggatgtagctctctcctgcgagggggtttctactttcttatatgagcgtctattgatctggaatttcgctcttcaagatagcacagcctacaaatgaatagagatactttcctatgtggataaagactttgtaagattcctggaagatgcctgcaaaattaaactacagttaaaagacacagttgatatagtaaaacaacaacaatgttctcatctaatgtctctgatcaagagcttgctccctatccttagttctaagtcaactttaaagcctgagtcacttacaatgtcacatctttatgttcggggaccgccgatggctcgatcttaccctcctgcacccaatcctcccagagagagtccgcgtggtcgctgagaaattaagtttgctgcattctcacccgggactgcttgtcatcacgtacccatcaattaaccaaatagaccttccaccttttgcagtctgtagtactgcatcttcgtatgctgcggaccgctcagtaatgtcttaggtatgaggaactagttcgtcagacctcgaccgtattcaccctttctcaactgaaatgtaaaattatcaacagcgtccgctctgagtaattattagaaaagataggtcaagtactttcaaatcacaggtgacattacctcttaattggcttattggtcacatcattctggaaccaagctgcccaaacagtaacaatgtctccgttcttcggcaattgcccatttccatctaagactttctttacaaatgacataggcatatttgctgccgtgaggtgtgaaatgaggaacacgacttcagacagtatatgaggaaatcaaaagtgttacaaatggcacaggatattcggttgctttcttcatagtctgtatatatatgcaattgaggggtcagttaaactataaatgtctgaaaggcgacaaagtagtatatgagagcagatgacagatgtcctcctatggtacataatctatcttgaaaacatgcaggcgtatatacctagaatagcagcccagaggacagaccatacaaccctccagagcggtaatgactctcccgggtgttttagttggtacactaacaatcttccagcgcaagtgccttctagagctcgaatggggatgagtttaaagctttccaagtctaggcaaacgcgcccatagaactcaatccctcgttgggctaaagacatgggacggaggccgcctgagcctgtcatgggtttccaattctgccattccgatgagtatcgttgtttcaagatctccgaaaccacagacactatatggccatgctgtacaagaaacaaaatcccgaagacagaatccatcatctggtcccagctgagagtaagtccctcatcctcagagcttgttccgatagtaaaaatagaatccttgctttctcggatctgaaaatggtcttttccaatgacggactttgttaatgtcaccatttgtctggaagaatcagagagtgttacctaccttttcgatcattaaaatggatctcggttgctgggactggatgctcgctgtctctcgaggagattgatattgtggatatcactttaatggcgttctgcagggtgactgatgcattctccattatggacgcacacaattgtgtagttcagtctttgtcgtaataacggtcaggatcgaaatcaaggcaaccggtactatgcatgcgattgacaaggcaaccagtagaactgggacgcccttcttatatccgaatcaatgctttgacaacagatcatactcccaactagactgggaaaaattgcattcctgtcctgtggtatcctgcatgattttgggataacacaatttggctcagaattcatagctcagaattcataaccaaggtttctgcagaacaagaataaggtgatttgattacttcttaatactctgttgcgttcagcccaaatattggtgtcggggtttagtgtttggacggacgctaatgcacgttcacgtttagttggcgcgcgcgccaactaaatctgcatatgatgtgtccactggtttactaagccctttggtgtggtaccgaagagaatgtaactgaatatcgatggagctaacttggaggtcatgatgcacttgtactctatacacgtgacatacgagtggactactccgtacatcacctcaggctgcttatctcaccgcactggattggttcacgggtagttatccagatgcgctagcagtgttctccacacaccatctagaataccaacatcgaataggcagcaccaagttgtaacggagccctagcagtggtaggatttcaactcgtcctcgagcctagaccaagtgaggtaacgagtagactagggctaatgactctacgagcttaaaatcatatatgtagcttgcttgtcagctaactagaacagtgcagttacataaaggcaagggaattaaattggaaaaattccactttcttagaccatgcttgaagcagaatctgtcttgcagcactgatttccacgtccaatcattgtcggttgggattccaatctcctcttcggaaaagcggcaatcggctgccactacagagggccggaaggcttcgttgagtggctcatgctcatcatcatgcatgaggctgtcgtacctagccacatgggtgccattttctgcgtcatcttccagcaacattggactatcatccacattgctacccttgtagtataagggagtagtattattactataaccagaagcagcgctagagccagttaaaatcattagagagacgcaaggcggatgaccctcgacgttgccagagttctcatgggtttgaaattctttgccccgacttaactgggatcgaatagtttgacggatatgccttctgtggtaagaggaggaatgaggtacagaggcagttatagagtagaccgtcctggatcgaagggtctttgagttttgaaggagggtttggcgatgcttgcggtaagtagtggccatgctgatgttattgagggtgaaatcaatgagagaaattaggaagaggaattggaagagagaaacgatgggcacctacacacttttatacctgtcactggtactcagcctcttctactacactagggaacgctgacttcaagatccctagtaatatctatttgttggtcagcaggactatctctagactcttgaatgaacatgctggtctctttcacaatgaatccatttcatactgtccgggggtgttattctccacatctaacaggtggtaggaattaactcccgattgccacgaatctcggacacataactcatatatctctctatttcatgctcaccccttactcatcgccccccgttacgatgccgccgtccctctcttcgtccctttgtcgcacccggtttatcctctcttcctttttttgggtcgcaatctgcggctgaacaaatccatcagtcctgtcaatgtaattatcatctctggggccatcactttcggcgctacgtgagtgacaggagcggcagctcttcctcttggccgtacaatctgtcctgcgacgtctggcttccttgcttccagattgtataggctgagacattggtaaacccaccgcaagagaagaatgcgtacgtagatcccgaggtgagccttctgtgtccagttgtgatattgactgtttctcggctggttgtattaagttcaaaaccctgctagaataggcagtgtcttgaccgagctcggaagcatccacgtgggcctcatctgtatgatcttctggcctattggtgtcgttattagaggcagcgtggctcgcattgtggcttgcatgactcccccatcaaactcagagttgccgtggtctataactttcccagagctgcagctggagagtggtatattcgcagaatctattccatgccggacggcgatcggagaaccgacatcatgcacgcgatctccttgggaactaacactgtcatggcatgtcggcatataggatcctgtactgacgggaatctcatcctgcatgctgtccccgacgacgtccagatgctcggttcccctatcctcaaccacgagcggaccttcctcaacatgtgagcaaatagctaagcctcaagagacgtagggcgccagatcttctcccaagctcgcaaaaggaacaaaaagcatacaactaatgattggaataagaacatagatatggcgaatatccctatgccggaagagactaaccaaaaaacaatgtaaatcagctgaagataaggcttgccctggggccaagagaaagaaagaagaaactgggcaccaattagccgtggtaacttcaaacaatatacggccttcaggtaccatgatgttcttgagataagtaggccatttccactttacacttttatcgttggtcttatggccacagactgtaattgtcgcgtaatcaggagatcctgagttgtcagtatcaccccccttgaactcaggaaaggagtattcttaccaggacaggtccgcatgctgcaggcaaccttaaaaggtgtaataaagcagaaacaaaggaagatcaataattgcaaggcttggatcccaatgataagcaaggagaggacaggaagagagaataagtaagtgtgcgtctaatgccccagatgcaagccgagaccgagtcattggagctgggggccggtgtgcgctacagctgcattacaccacctaccatgtaccatcctgcatcgggactcctatcccagcacgcttgcgattctactactgtaaggcgtctaccggctttttgtttgctaaattcggaatcaggcttagttcgtattgtgtccgtcgcgcaggctagtttgccaaggtaaaaatacaatcttcagggtttctcggcaggaactcatcactaaatgcctggaattagcaagtggcataactgctctacatgccaggatatactgcggattctgcaaatctaaataatggtcatcgaaggcgtcagagggccttacccggttaggccatgttagtaaagagccattctgattgcagattatttcaatataatctactattctctatctgggatcttcatacgctcatgtattaaccctttgagtagtctagctatctgacttcgagcaacatcacgttgatgctttcttgaggaaaatggttctttcctcacactcctcgtcttgcttcatctaaacattgaaccacctgaagtatacatacatctcaagttacgcaaactttgttaaggccggagaccctttccaataaggacggaagtagtgaacagaggtaccagcacattttggttcctggatgatttttcgctagtaaccagtcgcctgagattggcacggtgaagttctcgaagaacctgtgtgtttcgcgcagtgattccaaggccgcaattgttctttcgcctgtcggttcttccatcaatctcttgatgtgacaaaaatgcggatctaatgaaggtaccaactttccattgtcgcaattctcctgagaccaatagcgttcctcgtctgtacaaatcttcacagttaccagaagtgcccccataagctcgtcgtggagatctgtattggtcgaacaaaacgtagatatgccctccaagacatccgccacatctgtaaggtatataaacgatggtacaggggcaggcactgcagcaaccacagcacaatcatgatggtattcgcttttcagccgaaaggatagataaagatcgaaaattttgtgccgcttgtccaacgccggtagttgtagacactcacggaaaatattcgaatgaacatcctgcagcaaatgggtcgctcgccaggcgagacggcataggatacgaaaatctgtggagctaagtggcataagccgacctcgaaagatttcatgaactcgcaatatgtccataatttgattggatcctagatccaagctggtctcgtcgtgaaccggaagtaaacacataagagtcaggaagtggacgatgaaaacaaggctgcaatgacgatgacttccaagaaggggcagtagacgtcgacgaagatcatcagcggctgatgtttgtaagaacaatctatattgctcgcatgcaattccggaccgtttcaaggaaatgataaccgacaaaattcgattcttaggatctttgagatgcggaatttgatcttcggtccgatatctgttagacgttagcaacaaaatatataaaacattgagtttcacactgacctccaccaggaaaagcagtagttctcctcatgcgaaatagaattcaagaaatcaagaccagatgttaactctgttccattgatgggggtgtcttccaattgatctgttttcgtgttttctatgggaagcgactcaaactcatgcttcgacagtgcctcatttttcttttggccatagtaaggtgcagaatcagacgtctgcaatggtggaaaaaaggacttgcgtgtagtcgttaatattgtctcctgggagtgttctactgctcgtgtctcggaaattatatgcggcgatttgaaggatttctcgtctcggtctttcttctccagttgctgttctgcatcctcgccagaagatatcaatgttgcctttctttttctcaggttcttcttgtccggatttgacaaaatttttggatatatctgtgaggagtcgggtctgtaacactccaggcgcttcctgctgcatgtgtcgcagggcgttgattcattgcatttgatgcgtcttcgatggcatgttaagcatgctctgaatatgcgacgattccccgtttgcacacttttaaacgatgtattctccatggatagagcacatttgacaacaggaatggaataatgtacaatgcattgattaacagataatcatggatcagagagtggcctctcaaaaatgtcatcggaaagaaatggtgatgcgaacttgtggcccaataaatatgcttgatgctttcgtcgtaatcctaggggtggtctgaactgttacatgcactattttgaattttatttagtaacaggacctagcccttaggaggcatttagtttgcgtctgttgttacgcaccgtcgtggcgatttgacagggatatcagaagcagctgaaccttgttcaagtcctgggtcgactattgtaatcacggtgctcggtaaacgcgcatgattcattcgcaaatgaccaccaactaggggtatgtcactcggtggatgataagtgattttcatgggttccaagcttaaaatggacttttactaactctaggctgcgcttgaattgggattttttcaaatcacagggtcttgaaatccttgagccatcctgccatctcggctgctctccgctcctcttccaaccgagcccgctctccagctcgatgatgaaggacaaggttcctacatgtatcctaatccttgattagccgtctgttttagtcaattctaccccctgtacaacctgtaacttgcctggtcattttccaatgctgtggtgaactcctcaggggtcatgaaccgacccccctctttccaggagtacttcgatttcttccagagtatttcgcgtgttttttcgctgtcacctctgcagattccagacacaccttggatcatttccctggtgcataccggtaccggattggcgtcatagtgccatacaaccaagccaagcctgtacttcgtgtcttgtgccaacgcgtctatcattgtctgcaggtcctcatcaggtatgggacaggggtaatcacagccttctggcgttaacatgtccatagcaatgcatcgcaaagctgtcatggctggaatatcaaaaaagggagactgtgatattgacggtggtcttcgacgtgcatcctagtgctatgagttaatataattggcgtgttagttgctgggggcggaatactgacattcgtagtgatttcagacatatttccctgacccagtgcggctgactcttgcgcctcgaaggcaagcttatcagattggagagaggcaaccggcagcggtagacagggtcgcattcgcaaggcagccgctcgtggtccttatagtgagtgtagcttcacttggcatgcttgcgagttgacagaggtgccaacctgtagatgccatgatctagacacatgaggtctagacttgcgggactctgtccctgcggaccctgctgtaaaagcattgtgacgatggctgcatagaaagcgcaccatggaaagccttctccagggtcttcttccgattgagcggcttagaagtccagggatataagtggtgagctatctattttaactcaagtcagaccccgcaggctaacctgatgcagcttaaaaggatattcttcaacctgcggtgtacagtatttatctctggtccaccacatggtgtcagccttctactattgaagattccggcagggcgaacccactcccggctcaattaggctgattcggttacaaatcatagtgcgctttgaggtatggaggattttgaagactcctgtgcccaggatctcataggccactttgatgctgttaccaagtcagaccccactgactaaccatttaaggtttaaaaaaactccgcggcttcgcgccccgcgcaacaacatctgcccacgtcccaacgtccacggaagggttcggtttatcgtcccagtcgacatggaagacctcagcggcggcggtgaaggacagtcggcatatgcgacctgccaatccttgtcaaatcaaccagtgattaatgtacatcaagaaacggcgggcttaactgcacaaggcttcctagacctggttgaggaaaacctggcaacagttcaggaattcttcaggcgtgatcgaacatacattatcgcacagatgaagataacatcgaatccccgaatttccaatctttcgcttaaaagatcctcgagcttggaggacaagttcctctgcatgctgcacacacgggaaacaacactgcaatattatgcaaggttcccccacttggatattaccaaagatccccagtggtgggttacaatgcagaattctggtaatcgatcgcaaggcaagctgaaaacatttgccgaggagcagagccttcccttaggcgccttacgcaaaggggtatctgtcacctggaagcagttgatagtcgaggtggagttgtcagcaccagggatagcacttgtcttcctccctgttctcagacggcttgagcatgtatatgttcctcaactaaaactactatgcgaccttttacgctgtgaccggtattcaaacatcttgcaactttcacgggcctattcagatatgatgcgcaattaccaatgcaattacaatttttgtattggtatgttgacacaatcacatagcagttgctcacaatctgacgctctcagctttcttgtatctcaataggaccaatgacaagaacacagagacacctgtgaattgatgctatcagaatgaattgggattgggttcccaagtctctgacagccaacatcggatgtagcaatcagcgcatgaaagggaccacctcctcttcatccttatctatccctaatcgtgcaagtccacgtgaatacaccattgcaacaaatgtaccaacacttttgtctggccagtcaagacagagatatgaatccacgatgacaacattacccgggtccaacaccagaggccatgccttcagcttcccctgtgatgcctgttgacggcagacatgtttttccagtttgtgtgatttggggtagacatagagaataaccctgttccggactgcccgaaatagaacgatcgcctcgcctcgctggtggccctgtggaccaaccctgtagagccctggtttatccgttgccttgtcgcagcacaccacgacgggctctcctggcatcccgtggtccacaccaagaagggagcgataaatgtatttctcctgcaaacagtaagtgagcttggtaaggacagacacaccaaaggcatactttagtatcattcatatcatagtccatgaactcgatgagtgcctttgataatggtgacccaaaggagcctctgaagtaataatcggcactcatttggtcaccaatggcattctcgatactcttcgccatatactccgggggctggccccagctgagggtggcatgtccttcgtaaactagggtcatcactgcatcgtctgcctgcgaggtgttcgcttcgtccatctttgccgacatcatgtagttaaggtggggaactgtgattatgtaatcacgggtttcgcgtctacagcaataactgttcgtccaggagaggaaaaagatattttacagttcatggtagttatatgcttcgcatcaagatatataagatcatttggattaaagaaagctttagaagccatatatatgagattgaaatggacaagtaagagatgctgcatgtctcacagtagtactatctaaactgaagcgccctctttccaacacatccacgagaaattgctgaaaggtcgcaagttaaggtggaaattctctgcatgtgtatgcagccaaaattaaactaataaaggcaatcgcctacaagagtatcatctcagcttcatcaaattcatcaatgcggtcttcactataatcagaatatattagtctctgaaaattatggcaagagacaaaccattggatcttacatccaaactacatttggaaggcatatcttgcctgtttgggcatatatcaagcaccacgcagtcacaagttagtgacaatggccacagcgatagttcacttgtttatggtcacacatagtggctctgtagtaatagaacaatcaacaaatgggttttgcccaagatcgtattgtataaactcgataaagtattgcagtttactgcgtctgaggtcaaaagacgcgtgattcaaatgtagatttgggtaggatgatttttcaaaagcccggataggatttcttcctagtccaagctacgacagtcaagggccagggctttgtaggtaacgtctcaaaaacttcaaatctagattctgagatggacctagacaggaactagtctcgtagcgcttgaagtggtgggtgaacgatcagcagtctcattatcagcagccctcacatctgaaccagtccatgcaagcaaataacgcgatctaaaaatcaaaacatcaaattccacatttaagctcccagttcgcgccaaagagagaagtataaagatgaaagccgttcacaagagtcatcaaaccatttttgcagttctggtgtcatgctttgtcttggtatcatatcctgaagtataagattccgcacacgattgtatcgactgcggaagtctcccagtccaagcaatttccactgaactggggaatccggaaccagacatttccaaaagtcccaaattgggtcattttcgccgagcatttcaaattcaagggccccataggcttctcgaacgcgttcaaagctttgtcgaggaacagctaaatcagcttggcgtggatccaatggaactaccgctctgatctctcccaacaagcctttggagtgaaggtttgcgcatatgctattgattaaggacgtgaaataggcggtgggatttctctctatcgtttcaagcactcgtttggcagcatggtaatcttgaatggtgttctcacaccactggatcctcacagtctgtaaggtcagcatttatcatgagtcaggacctgcaggctactcacaattaactcggtgtcggtgttgccgctcatgtttaatgacagggagacggtagcagaacccaaaagataaggcttgacttcagatgcttactgctgataatgccagccaaagctgctacagaaccagattaacagggttgggactcccttatgtagtcgtattagatctcaagtgggtggaaaactgagtttcccatggcttccaccaaaggtgaggctatcgttgagtgccctttcttggactagttggcgcactgtgaaagacagatatgatttctaatcatgcacagtttcattcgtgaactcaggaggcgaacccaccccagcctctttttaaggataggcaagactaaaaacatctcccttagtcaatcatgcccatttctcctggtttatccatgggcttggtgaaattggcgaaccatgctccatgtcagactatgtatttagcctcgaggtcttctctagagctgcaaaaaagacttagccaatgcctaaaccacgtaacaaatcatacctcgtatctgctgtaacaacaaggttgacttgccggttcacccaaaccgcgcggccatccttcaacgcctgagtgatatggctgggtagttcttcggatactttcctgtcttcctgcacagagattcagctgccccattctgtagattcaggtataatgatactctgttgcgttcagcccaaatattggtgtcaggggttagtgtttgaatggacgctaatgcacgttcacgtttagttggcgcgcgcgccaactaaatctgcatacaatgcgtccattggtttactaagccctgtggtgtgttgggactgcattgctgttgtgataattgtcaacccacatttttatccattcagtctcctctcactccttgcccttcatcaaaataatttcatcatgactacagagatatcttgggctttacagattctgcttcaggcatctcctgagtccctagcagctcaccgctttgaggtgcttcctgccctgcgagagattttacgccgggttctcgtgtcctttaaaattcaatcaagacaatctgagcagagacatgccacaacagggctttcagtccaggttagcaatgatgccgatgactttcgtaccgaccttacacgtggaacagcctctgcatgttccgaaacagcctcacggttagatcactcagtatcctcactggcatctgatggggataacgacttgaccattgctacgaccgtggaagaagctcttacggacgacgaggccaccactccgagcgatgactcatataagaaattcttcaaaaaaattaagaaatgcgttgcggagattgaagatatttcaaagcgtcaacctgaagacctcatcacgggagtcttggctacgttggatggcgaagatgggcggctggcagatataaagcaaatcgcgggcaagacaaatccttctctggaagagagactggtccaatgcctagctcaggagtccatagcactggaattcactcattgggagcaggatgaactgcaggtacagcaaacaaggctggaccaactgtgctgtgaaccttcgtcttcacaaaagaagcagacaggccgtatttcacaatttgtacggcaccgattccacgatgaagaatactctaggaaggtcattcgatatggtctcaaacaactggtgcttaagaacagatgtcagcaggagctccgctgcgatagcatgggaattgatgttggcatagcttctgcttaccgaacattttgccgtatgaaatatggtcagataccaagttttgtcttgcttctgtctacagatggacaagcggcaccaatccaggatagggtctctgggaatccgccttcaactgacgcttctggccacgcgcaaccgactcagacttcagtcaaagacctgttgttgggcctctctgcgtggactatgaggtgctataacttctactgtggtaagtgagcgtcctcacaccacctgtattcatcgccatggattaacacgttttaaagagtacaggagaagccgtggaatttgtttaattcgagtttttccatcgcataaaggcaagaggcgagagcggtcttcgcgcccagactctgcaaagcgtcgacattccggcagacgtcgctcttgtcataatgatgaggatccgtcgcattctgacgcagctggagggttgtcacgcgtccatcctggaaatcttacctctcatggctatcaaggtccttctggagaacaaatacgggatcttcaccaatttgctcaaaggcatgcggatctcacccctcgcgattcggagcattttacggctccatcccgtgcatcataccaggaccagagatttagcggatctgtcgtgacacaactgcaacaagatgcctcactgggggccacgaggctacggtttgatgagtatcctcaaccagaaacctcccgcgctgacgaccatggtattgctgatgctcttgtggcaatgcgccaacattcatatcaacctagcaacgatcaatccgatccaagcagatggacgccactgcatgctcatcagcctggtcctgtctctcagcgtctcgccactcccgatttagcgaatgactcgccctcggcgatacgacagattgctcctcagtcccttcttcctgatcctcgcagagagggcatgtgtaacgcatcagcgggaatggaccagatcgcttttcagcccctagacctcgatctctacgaaaatagtatttttaatgcgtctctgggattggagcaaatagctacccaaccatatgtttacgagtctaatggaggagggaatatgcaccacgcccaccatgatgcagcaacttttcttccagcgatggatcaagtgtcggctccagagtatcattccaatatgcaaaacgctgaatatgtttaaagtatacttcttgaggctctaccggctcaggtcactgaatatacccatgcccccagtttactaccatcctcgacaataagagggcattttccaaacacattgtaataatgcttcaattggaggacttcgtcgtgaattttcacctttccagatataaagaacggtatcaacgccacatagggatctccgaccgggttctctccagcaaagaaaatttgtatggcgggtttgattcctttcggcttggactgtcggtactcacgtttgtgcggggcgtcctgttcagagtttaggcgtgctcgttgtacaattgctgacgcatttgtctcacctcgtacaatcgctctatctctgttatcacctcccaaccatgacgatccacagtcatagtcacaaccgggcgatggttggaactagaaagagacctcgcaaggatttcatcggctttggaggctttatcgtataggacttgaatagaatcaggtatctccttggattcgacgaaacctgctcccgggctattggtagccatcacgagatgactgcggtagttcgtttcgaagatgccagtttctagagagggagtcacggaaaaggcatggaaacttggtgaagctgatgaactgtttgtcagttatatataattacctattgaaggtgtgagcgccttacatgataattttggggggtctatgaattataacttgtatgaggttagaaaggacgaaaatgaaatcaacttccttagcggggcgtagcggggcgttgctaaagcgttccttgctgcccgatgtgtggccggagtctcgtgactcctactcgttgtggttacgccagccttggggaacaactcgcatccaccaaggatcattggagtaatttgatcacatcgaatatcctgcgaagtcgcctagcagcattgcgcctgaccagcccaccttttggttgccaatcaagagagctattacccctagatttcagtatttgatggccggttatatatcgcaacaagctctacaatgtccaacttaagaagattgtactagtgctcttcctcgtagacttttactctatattacatatatctatgtttcatgaaagaaggcccagttcacaatactttaccattatttgtccagcaaagtcataattatccctcaatgactttaagaaccagctcatataccaagtataatcacagcagaaggcttgtatatatgacacataagtcgagtatactgctaaaccttatgctgcttatcttattgcactgaattgttttacatgcgctagaagaccggtttttctctaattatgtagtccaaaataccttcgaataggcagcaccaaggtaagtaacggagccctatagtttgaacacgatactaggtctgcttgaggcctgtttcgaataatgcagcatccttctaccctactcttgctgcaaccttctctatggagttgatttggtgaaaatgctccaattgaattcctttacatgtgagtcactgccagctgcaatgctagttacatatataaaattctactggtgcctttagaagatatcgcttcacgtatgaatcattactagttgggatgctagttgcatttgtgaacttccactggtgccttcggaagatagcgcccagaagggcgagccaccagaacagacctgcatgattaactcgaggcaagcaggcatccttccgtggacaggccacatctgcccgtatacttcagtagaggcagggcagagatgcattacgtcgcactgtagtcccctaggtgcagcccacgcacttttatcagtcctttttccgactacatatttaatgtagagggtatacgctggtggtgcgagaagcgcacaacatcccagcctgacaattgcgctgaattgtcgcctgatacctaacaagctattttttcatttttaacattcaactccaatgttcagctacgctaattacacgccatggcttcaatgaaaaagacctttagtaaggaagactgtcaagaaggtttagaaccgccagcaaaacaagaatggaggtatgtaacactggtgcttctgcagtattcaaccagaggccttatggtccaataatgacgcatataatcggatgttttgttcttgtcaatatagttactccaggctgcttatctcatcgcaccggattgtcacggaataccgtttcgaataggcaacaccaagttcaatttcaccgtcacaaactgctgctgtttgtccgggaattgaactatccttatcaccgacatactttggactacaaaaaataaataaggcacaaaggatcaaataaataaatttttccgacgtaatagcctaggaagatatggcttgtcccttaatcgagggtttacatccaccagctgttgactccttgaactagacgcaagcaacagaacccacgtgttcctttcttcgtagattgcacatggaatgcaaaattatcagtcaggcctatgattggtcaaggtgggtagttactgtagacaacagtgttacctggctcaccatttctttctggatcagttgggatgcatcctctgtctttaatttgcaaggtcatctgctgctaaagcagatgtaggcttagccaaactactggtcagaatgcgcccaattgcaagtgtgacatatgaaagtgcacattgattagtatctggttgccaaggcaggagtctgcgcagactgaaagactgtagacaacactgtggggttgaccaagaaatcaaagtcccctgccacgaacttgaggcaatgccagactgaaggatgcgcgtcctcctatgtaaccccgcttctaatccatgcacaagaactggccatactttcaatataagaagacaggtgaatccaccagtaggcgaaaacttcattgtcaacatcctcctggtctcttgcaattccatcactggtatgtttcaagtctcgaggtaccactccttactttgagaaagatttgtgacttcctgaactcaacagatctctgtatcattgtccttcaatccaaatcatagcattatctcagacaatgactcaactataaaaaatgtgcagatatatcgacacaatctttatctccacacagtgcacagtcgacccaaagcatgaagttaacaacgcgaacgtacaagatctgctccaacccaaaccctattagtacaaaacggcactgtcgtgattcccggcccagcgatgatgccatacttggatcaacaacatgaagaggagaatgtcctgtttgcttgggagagatgtctgaatatgtggaggtaggataaaagtgtgtagaaggaatgtcatccattcatctgacattggatctagatcgatatctgacctaatgaaatgtcatcctgccttggaacggaatcgcaaagttacagcgaaaatcacgagcatggtctgcgttccttgtctgggcggtctggggtatatataggtattctctgaggcttcaattctggcctccagctcccgaaacggctttgcaagtccgcgctcgctgaccaaaacgccttcaagtctttgaaaagccacggtgtttgagcaccatgctcccatctgtctctcttattggcgaaatagtgatggctatcgagtgcactagtcttcagggagctgacgtcaggtccctgttccagcaatgactacttaaagagctccaattcccttcctctgtcaaattcagattttctctcgttgctattcattaccattgatatgctcgaagccatggacattataagtatttacgctatcgccgcaggcggcatttttgtatcccccattctgctcagggttgtgccttatctcatacgattgacaaatgctatttccatacttattccaaagcatctaacctatgcatatctccttaatcgtcaccggcattttggtccttggacacctgccagtgtcctcctacatttcacttacgtggcagtcaacatcttctgcatttcttttcaggtaccatcggcagccggcgctggtcgtcgggctggaacattgtcactcgtcaatatggcgtttctcttcatgacaacgtatttggggttccttgcagatgtcttcggggtttccttacatacacgccggcggatccaccgcaccacaggatggatggcgggtgccctgccgactgtccacatcgtcattgcaacaattgtgcagcaggcaaatttttcgctgcacaagtctgacaatctttttgctctcattgtacgtcctactgtctacaagagcagctgtgaactaaccacaaacacggtggaacatcattggtgacgcttttactattttctcttccgttctttcgtcgacttgcatacgagatctttctccgaacgcaccaaggactagcggcagcttgtctctattccatttggcggcatctgcaatctgattctctccttccccaaatctgtgtctacataccactaggagtctttttgctgacaacgcttctgcagctttggatcttcctgtaccgtaacaggatcttttcgtctcaccggtatcctcgagcattagtcacctgtgacaaggacaacaacggtgacgagaaggacgatgatgacaaaaataaggagaaagtgatcaaaatccgtgtcggccttgcacgaccactggaagtgaaggccggccaatacatcagtctgtggatgccttctgtgagcttgtggtcctggacgcagactcatcctttcatggttacgtcttggtccccaggcaagcaggatactctggaactctttgtgcagactcgccgtggtttttcagcagatttgcattcctgggcagccaaagaaggttctgcttcattccttgccttcgtcagcggtctccatggtaccagtgagcctatcggtcagtatgagagcgtcttggcgatcaccagtggctttggtattgctggcgtgatctcatatctcaagcaattgatccatggctacaacacttcgacttctcgagtccgtcgtgtgcattttgtgtggcaattgcggacattaggtacgtcgatctctcagaacggaaggtgctctgctaaaaaggccagatattgctattgcagcccaaccgctgctaaacagtctcctgagcgatgatgttcttgatgatggctatgtatgtcaatctcacatggattcaataacaagcatgctaatagggaacccagatccttgaagtttctctctatgtggaatccggcatgacagttgaggatgaaaagccctttggaaagcacgaccgagcctttgtctacaagggagtaccggactaccaagaggtaatatctgcggaggtttccggtgattatatcagcgagttattggcaatagaggatatcaatggacgtatcaatcaactaacccaaacagatctggacaccggatgtcttgaaaaagcgtggcgatggattgatccgcaatcggctgcggcatctgctcgctctaacttcctccgctgcagaagagatatacccattcaagggccagaaggctaaaggcagccttgatagagatccattgatatttaccaatgcctggttaaggaagtaacagcctacttccatgcatgatggtcttctattggcgcccatatcacgtcaactccaatagagaaatgcttcagttgagtaaatcctcgatggaacataacgatatccctgacatctatcaataatttagcacagttgtgctaattaggagcttctttttttatttttttatttttttttattttttgcttttcttgttttttatttattcgtcattcttccagaattttgtattattctcatttgggttccattactgttgctgctagttttccgatgtaatcagtttggagtggtgttactcggaatgcgctatcttaaggaggattttctctatagctaacagagttggaatggctactccaaatatttctaggcgagataccttagggtaaaagttgctttttgttagagaaatagggtttattatagaattgtcagttgagtatcgagtaatgagtaatgaaaattcaaggcactgatgacgcagagcgatctggttaaaggcaccctatcgtagctagttagttagaaccaggttagttacgtaagatacctgagacccaagttgtaggctgaattgcttccgaagccagggttgtcagagagtgatccgaataatttggatcgacctactctgtagttagttaactaggttagttagttagttacttgccagcatgattatataagccaactgaagctggtaactagttaactattctataactgttctattcttgacggatttggcattgcacggacaggctgcttagctaagtcacctgaactcagctgtgaagttgttcctctcataatggaagcgttcaattgacccttgttcctacaatcaggcagatatcagacggagtcactcagagggtcgactattctgagtatgtttattgatagacaaagcccttcgtagatgttaaacattctcttgtgtcacatattggaatattaggaagagtcttaactgcgaatacgattatggagtgtacgagtagaacgtgcgcgcagaaatcagggcaaaccgagccaagtcaaccagctcgcccctagagcaacgccgctttgttatgagcgcgtgctggagagttgcgagagattagaattgaactctaaatcgagtggaggcgggacttacgccttttagttcttcgatagaaccagcagaggtagtcgccgaaaggaatccaacggcatcagaatcgaccggccatcgctctacatcatccaccccgatcaccccgtcatccttgacatatttttgcattagctccatagtaatggttgccaacgctttcatggcttgagcctgtgtctgatccagaagatgcgtatgacagtcctccaaggccgctaagatatcatcagtactgtcctcagcaacgtagggactatgtccataccgatctggataaccccatcaagccccaacagtatattggaggatatcagagaccgatgctcaaaaccggctgccgtgagataggataaactgctgaggacctaccgacagttaatagaattcattagcagtggatcagcgggggattacctgggccaggatcgaagctaactggatctcgctggggtaggcatcgcaggcaacgaggtgttccagagtgagagggagatcttcaaaaaggacatacatcgaatccttgaatcggaagcattctttggcagagacgatattttcgtgctggatctggcggaatctctacgacatcttgtctgcatctcttttggagaaagcccggatggctaggactcgggaggggcgaatgcgatgaacgactatagcaacggtgccagcgaggtcgcagctgtagaccttcctaaacgtatcccatggagattcatccctgacaattagcgactgagctgcacgattttctgaatcgacgatctgccgaagagcgagttctctctgcgaaccccttagaagctttccagggggcttccgagttagagatactatcttcttgttcgaactctctgtctgagtgtcaatctctgcgcgagtgtcagtctctgggggatgtagcccatccgagtacgacaggaagctccgggcatctcgtcagacaaggcgataccctcactggaccaatctgcaggcttcctcacccgccaaatatttctgtccgaaatcgtctattcttgttccttccaagaagatagaggtccatcggttccccccaaccctgcgagaaatcccacggatggtgaaggtgagggcgacagcagatattgcaaggccgtccatctccagaaaggtttcggggaccgctgcagccaagggcactcgattctcacgcgaagaggatgagctcttggtgaaactaaaggaaaaggacaatctgtcatggagtgagattgcaaagcatttcccagagagaacgaggagttccctccaggtacgctactctgcgacactgaagcatcgaaggtcaaggcctcggggaataaagcagagtggtagagccgagtctatactagatgcggcccctgcttctagcgggttgcggcgtagtctggattctagggtgcaaactgtggacagaaggcgggatccctcaggctcaccaataaacttgccgtgccgacaacgatacggcccacctcgatccagacgtgcagtagaccgctatggatattcagcggcataaatctattcctatgagttgtaccaacttattccgtgtggttcttgacctttccagtcaattcttgttttattttcttttcgagtggaccattagttcccagctttcgtcaataaccatttaggtgtagtggaactgtgacaatagtcttatcgttgcttaatgcccgctgtgaggatgaagcatctccagagtaaagccgtattgattcttggcatccgggtcggctcccttctcgagcaagcattctatcgtttgctagatgcctttttggtatgcaaagtgaagcggtgtcattccttcgcgatcttgggcacctacatctgctcctcttcctggaagaagtgcgacgatatcggacgcaaagcactgcgcagcaacatgtaacgctgtttgctgcttgtaatcaataatggatgtgtcaattccatggtcaagcagcacctggaccacttccttgtgcccgtatagaacagcttcaaggtggtgtagggatctggagctgtatattgagctgtgagagcacccatcctaaactaagtggcaccagaccagttgctgcgaagccatttttgatatttttctaatttgagggctcccaaacgagcttttggatacgctgcaaggaaatctagcttgtagatatgattgattccaagccgcatactttcctccactaagcggccatatatgcatttcaaaactgcaaaacagccgacatcaagaggctgtagaagatgagatgaatgtggtggtaggcaaattggtataatgttgttctgggcacaggtccgatcaaattgaggagtcagatggcttccatgcccgtcaagaacatccgatatttcccttttgtacgagtatttgtataggggataaagagattttgaagccatgagatcacaatatcgtcagtggcctacccattagaatttatctcaatcctccagtcgcgtggtaaggcctcattctcataccaggcctatagatgggtcttcgctttgaatatgatacacggtggcagagcccatccagttaaattggctgattcaatgacggagacccattcccgattcccaggctgtataagaacagggcgactaacagtctctgctctagtaaccacccttgtagtagcaattaggcgtggtccggtcagaactaatacttatcgtctgttcaaggggggagaagtaaggctcccttagcagcgaggtatccaagagttgagacttggaaatggtctccttaacaccgcagcctgagatcagtccaaccataccccctcttgctccacgccatattggatggcggagggaagacacaagaaacagaacaaatgacgtggcacccaagccaggcgcgtctcctactgcaggcatcacagtcaatcacgtattgctcggactctgatgagaacagctagtcagggctgtgtttcttgttccagacttcgcctcatttatgcctcataggatacagtatctaacgacttgtgggagctagcagtgtagccgactggaatataaaggttccaatatctccgctggtctgacttcattcgtcaccaaacttatcccgatcagcagatacaagcatacgattcagattacctcatctgtaaagatggaggaagttcactcaagcggagaaaacacgctaacccttgctcgatcaggtccctcgtacaccaaggcggacgattgccagcattcgaaatcgaaaacgtttaattcaccacaatttataaatcaaaagcgaaagggctcagagaatccagagatcaaatctgatagccaccaagattttgaaaatgatccaagcactcgtgggaacccaatcaaaagagtgagaatgcagtcaccgaaacgtggcaacaccccgggagttccagctcacagttccggtaggccttggtaatctgaggtggtaggaagtacgctaaccaggccagataatcccattataatcgaagacgaagatatcgcctgccaccaattaataataataataataataataaggataacttagggtggttaatttactaaatttacctaaatgcatctgctcagaagctaataaatatattacaaggctaaataaccaaaatgcattcgcttatttatactaatataaatactttacttgatatataatgtccactcggtcgacgagctctcacctctacgtggtgactgagactagtagtcagtcttacaaagctgatgatgccaagaggagctcacattctttttctgggagttttttgggccagatttgttgaagttttgacctattctactcttatgaaaaattttcactacctgctgaccacctgcctactattgatatctgaccccaatatcgagcaattaccaaatcgaacacctagatatatataaaatatatatatctagagcctatctgcctgcctagggaacaggaaggggcccagggagccagattttctaggctttcctggttccttgccttggacttcccctttgacccaactggctgactgaccacctgcttactattgatttctgcccccaaatcgaacaattaccatgttgaatatctagatatctatatctagagcctacattaggctatattcaacatatagcctctaccatctagccagactaccattcattgacttgtgatttatttgttttcctaccacctgcttacctatcttttatttcctacttttccctaactaagtcctattgcttaggtaataggcagaccgtgcatagtctttgactgaaaaacggtctctaaaatggaagaataataagttaaagcatgtcttgaaatactaccggcttgagtgaccacctaaagaactggttcacctcaaatgcatggctccacagcagccgaacgggctcatttccatcaggttccatgttgtccagcacctcaatgttatctaagctaaaaagtgtgttatctgcaaatgcaagcattagtagataggggaccagattgaagcaaagcttcccatgttctcttattgctacggggagctgataaggcgccgtgccagctattcttgtcagcagaccgccctggctagctgcagcgggcaggaggcagacgcatccagcattctcaattaactacgccaaaagcggccaactgagctggaatgtcaataagacgatgcatctcaagcgctacaaaggccagcagggatatccatgaaatgcaagctgcttgtgtcccgtaatgtccagggactggtcacctgactgtcttaattgcggggaggcagaaagcgtgcctgatcgcagacacgtgatctcgcaatgggggtggcgtgtcgccagaagggcgcgcttaaaagaagaggggaagcagactggagacgggcggaaatagtattaaatcgaaagaatgaggcctgaggagttcaccaccgtgtgattattgccattcgcttccgtataagcacattccagcgccacagccatggtgaagatcgagccctttgccgtcgaacaagtacgtacgatgataataaacccgataagccctcttcccctcccccacagcgagttccccgcagcaccgctctgactggttgcgacttgcaatgtattgtatatacatagtggatggaaaagtacgagacgagcaccacatacaacatcgcagagacgtgctgcgcttcgatctccattgacgacctgacgaacttgtcgtcggaaaaatcatccatcgaccccctctcgctctctacgaggaaactcacctatggcgccatcaggggttcggatgagtttcggggccatctgtcccacctgtactccgtcaagacgcccacgccgctgccaaaggagaatatcctgatcacggcgggagcgatccaggccaattttctgctctattacactcttgttggtccgggagaccatgtcatctgccactatcccacctaccaacaactgtattccgttcccgagtcgctgggagcggaagtgaccttgtggaaggcgaagcaggacgatgggtgggcattggatgtcaaggagctggagagcctcatccggccgaacaccaagctcattattctcaagtacgtctatgtcggggtccttctgccaggctgcgatgaccaggactgaccacctctcagcaaccctcagaatcccaccggtgccatcattccccgctccactctcgaagagattgtcgacatcgctcgtcgccagtccatcatcattcatgcagatgaggtctatcgacccgtctttcactccatctcgccgggggatccggagttcccgccttctgtgctctcccttggatacgagcatacggtcgcgaccagctcgatgtcaaaagcctacagtctcgcagggatccgggtaggctggatcgcatcccgcagcaaggccatcattgacagctgcatggccggcagagactacaccaccatctccgttggacagctggatgacgccatcgcgagcttcgcgcttgcgccacactgtatacacaatctgctgcgtcggaatatcgacctggccaagaccaacctcgggctgctggagaagtttatagaatcgcaccggtgggcctgcgattgggtcaagccccgagcgggcaccaccgcattcgtgcgcttctccaagatgggtcggcccgtagacgatgtcgccttctgtaagttcctgaacgaaaaggccggagtgctgtttgtgcccggcagtctgtgtttcggccgggatggggatttcaagggctatgtccggatcggatatgtgtgtgaaacagaggtgctggagaagggcctggagcagttgcgagagttcatgaagaagggctttgaggaagtccctttagcggagtagtctggtccaaacagcatcataatacaataaataaaaaggggaaatagtgacttcaagatcaaccaagggaaacaccttaaaaaaaagaatacttcatggagcacaatattccccatataatagagactgcgaagaactccagctccgcgtgatggtgaacttgaaaatgatttattttggtcgagatgcgagccatggatagatacctacccggtaactttgcatgtgacatgtgactttcatgtgactttcgactgccagtacagaaccttgattggattattatactcgtctgttattgatgtaatctggcattaggaattggtatatcgtttttcctttcgttttcgctatgatatatacaatataaacacggaattttttaaaaaaaatcttcgtaatgcaagccgacagcttctcataaagactcgattcatccatgttttattaaacacgctccatttcatgaacatcacgcttcacttctgctatctcctgggtcactggtaacttctcttctttaccctcgaagatgtacgtcagctcctcgagggtcggccccgccgtctcgacaaagaagaagtagacaatgaggaagatgagagctacccagacacagtagtagatatagaaacgccagccgatattggccagcccgatcgggttgacgtaacccccaaagatggaagatacttggatcgtaagcaggacaaagacccacgtcttggctcgcatctggtaggtgacgatttccaggggatatgtgacgaccagattcgtccacgccatggtgtaaaaggcttggaagatgaagatacaggccaagaccaagcggccagcagccaaagaattatgttcgatgtattgctgagaagcgatggtccatacaatgaagacgacaagcaccccgccggagccggtgacgaaaaaggtccggcgcttgaagcggtcgataaaaatagtgacagtcactgcgacaatgtattgccaaagggtcaccatgccgttgacgagtgtgatctgggcctgggttttcaatcctgtatcttttaggatctgtgtgaggtaattcgaaacgagcaggtttccggagctctggctgaacagggcggtcagaaagcagagtgcaatgcgtttcagattgggcaccgaagaaaagaagtctctccacgtcatgttgttttcagcctcctttgcgaggacctgttggatctctgcgaactcgaattcaaccagcttcgaattagggtcacactccccgtggtacttgacaaggatatccctggccttcttaaggcggccgtgagcaatcaaccagcggggagattcggggcagaagaagatcaagcagaattggtaagcggacggaatgatctggatcagagtaggcaggcgccatgaccactggctattgattcgataacatccaaaggtcacccaggcgccaatgacataaccaaggacaatggatgtgttgtaaaaagtagttatctgcacacgctctttcggatggctcagctcggtgacgaggaccggcgcgcccatttggatcagcgacgagcctactcctagcactatcttgccgccgatgtacatgttcagcgacgttgcgaagaattcaacaatgactccggcaatgatgataaccgaccccagcgccgttggcactcgccggcccaggacatccccaatccaaccgagaaataggaagggaatcaccccgccaatggcattggcagccccgaagaaacccagcttggagcccgtgggatacccaaagcggctttgccaggactcgagaacttgcatgccgtttgtcatggactaaaatagacagttcagattgtcaatgcgcggcacccggaacctgcaactcagcaaaactcaccccatcgattcccagcgcagcactcgccaacagcgacgaagtaagcagaaagtagagcaggatgccattcttgcgtcgatagaagggcgggatcgacttgaggtcaattggtggcaggataccgtcgacagcgtgagcggccgcaggagccatctcgaccagtcacgctatggacctaggaacgaggatgaacagagaagagggacgaagactagaatcttatcttaaaagcaaagagaggagcgtggtccagaacatccccgcaattgacgttctggggctgttatttatatccgagatgacgctgcatcaccgtgcgctccgtctgacagcttcccttaagacacgctaaccttaaattactttattttccttcctctttctcttctttctatttttctcacctgtttcttccatccggggtctggggaaagtcccacgggcctgtgcggagaaggaactgtgcttggagagccagaccatcggagaacaggagaatcggagaattctacggggtcaacgggcacatctaccggcgagaccatcggcgtcgaactatttgtacaccgctggaaagacaaaaagagacgcgtagaagcggggtcggggattggactgggcgcgggctgcgttccgcagacggagcgggaccaatgggcatgccggtcgcccacgtgggcgtttgtccgcgatattccccgatgaccagggacgagcagcttcactgacatcggcgaatctcccatgccaatgaccacagagacgaaattcatcatgaaaaaagataacaatgggcagtggaacaacctggatcgaccgcttttcgggctgacaggttcaggtggattccggtgggcgatcaaatccagccgcaagtcagttgaagttaactccttttcttctttctctcttttcactccatctctgcagctgctgccttgtcaatttgttctttcgttgctgccccgtcgaggacgacaattgattccatcatgcctattcccaaccaattgccccatgatttcgaatggggatttgcaactgctgcctaccagattgaaggagctgtggacaaggacggtcgcgggaagagcatctgggacactttttgccatctggagccttcaaggactaaaggcgcaaatggggacatcgcgtgcgatcattacaatcgctatgaagaggacttggatctcctgtcagcctacggtgctcaggcatatcgattctccatctcctggtccagagtgattcccctgggaggtcgaaatgatccggtaaacgaagccggtatagccttctataacagactgatcgattctcttattgccaggggggttacaccttgggtcactctctaccactgggatcttccgcaggcactccatgatcgctacggaggctggctaaatgtagaggaatcgcagcaggactttgagagatatgctcgactctgtttcgaacggtttggggatcgagtcaaaaattggatcactctcaacgagccatggatcgtatccatctttgtgagtctgtcgtgaacctccgctgggaagcatgacgttcgatcaactaatgtctccccaagggatatgccacggggatcaatgcgccaggtcgcagtagcataaataaagacgcctctgaaggtgacacgtcaacagaaccctggatagtcgggaagtctctaatcatgagccacgcccgcgccgtgagactctacaacagagaattccgtgcgtcacagaagggtgtcattggtatctccttaaacggtgattactatgagccatggaacgccgaagatgatcgagataaagctgcagcagagcgacgcatgcagtttcatattgggtggttcgcaaatccgatactgtgagtggcttgctgctttcagcactccgcaactcaaccgtcgagccctcctaatttatcacagtctggccaaagattatcctgaatgcatgcgcgaacagctcggtgagcgactgccccagttctccgcagacgaattctcgcttctgagagaagcagaggtggacttttacggcatgaactactacacagcccagtttgctcgtcatcgatcggggccgccctcggaaacagacttcctgggcaacgtggatgagctgcaggagaacagcgatggtgtctcgatcggagaaaggagtggtgtccattggcttcgatcatgtccggataaattccggaaacatctgacacgcatctatcgcctctaccagaagccgatatacgtcaccgaaaatggctgtccgtgtcctggtgaagacaagatgacgcgcgatgaagccgtcagggacacataccgcatcaagtacttcgaaacgcaccttgacgccatcgctcaagcaataaaccaagatgccgctgtcgtcaaggggtattttgcgtggtctctgcttgataacttgggtgagtttggacttccttgcctctgtagtaaacgctgctaattcagctcagaatggtctgacggttttggcgttcggtttggagttacgtataccgattatgacacattggagcgaacaccaaaattgtcagcgcgtgtcttgaagcagttgttcgaagagcgcatgggaagacaggcacaaaagctctgtcaagaacaggattctcgggcataccaatcagagagccccaagccccgtatgtgagataggactgcaagcatcggggagttttggggctcactgtgaaaaaaagctgttttctcaagatattcccgatcaaggtgataagagcttttttggattgatagacattctcaatagacatagaccttattcttatcccttctagtttaagagaataggactttcggtgcaagtcgcttgggcagcgcaaatttcaaacaggttatactagacatgttagtgagggatatagcgagaattatggcaagtaatacaaataggaagcctgcccagagagtagatcgtaaaaacttcgtcctcagtaggcttggtgaccgaaagtccctggcatagacaaggtattttctcttcaaagcagtcgaacgaagaaagacctttgatttgtactgtacatcacatcatgagaagcaccacgctagggaacccaggaactgttccgcaaagcgtcggacgctttcgaatccagtcttgttagaatatcgagcaggaccgtaaagtcacttcgtgctcgggatgaaagcggtgaagttttattccgatggatgattgcgagtaaacttgccccaatgagtcggattttttcaacctgtgccttacagtcagaaagagagcgcgtcttcaagatcccgacagaaaaattgagtcatgcttacacagggctctccattaacctgcaacgcccagaagggcgcttcgcggatcacccgtaacatgtcacgggcgatttcggtttttctcaagagcaacaagtccgtttgttccactgtcggagtcaagaattctggtccctcaaacttctgagtaattaccattctgaggcagtggaacgagacctggagattgaccctctggatcaccgcctgctttgagtgatcgcgtccctcgtttgcgctcccaaaattgtcgatctgcaaatggagaggcagatcatcgagacaggtcatgaagcgaacatatagcgcatcgatgcgacctctttgttcgtcagtaaggggttgtcccaggacccggttctcttgtaagattcttatttcaagcaggagatcagatgcggcttgccataggcgtacgtttgcattgaatcctgcgatgaagtcgggttgcgcaatatctgtccgtacttggcccggagaaatggcgggttcattgacaatgccagatggatagggcgtcgtgatgcgagaatcgaacgaaaatttatgcaaggtaatgggacgattattcaaaatagcagctgacttatctcccatatagacaatccagaacgctctcctgcgcagctccgcctcgacgggaaacaatccttcgtacgatgattcatcatgtaattgcatcacctggaccagtctggcggcctctccaaaaatatgccatgagtatttgggcttgccggcggcgtgaaggcagttggaatgaaagtatcggatggtcaccgaatttgcattcgggtgttccagatcagcctctatgtagctgtttagacaatcccgggaggcgttcagaaacacatcggcgatgaggtctccttcaggaaagatctctgctggaagcagggaggctgcttcggcgcaaacggccgtcagaagtgtgaaggtggactcgggccatgattctggatactccagggtgcccaccgtgtccagagtcgaagtgtcactaccagctgcattcctttgaacggaaggtgaccagagctccgcggtagtcttgcttgcgcgtcgagcgtgaagatttcgcgtcacgaagaagtctagtccggcccgcagactcggttcgtgaaccaatgggatcaaagggaagagatactcgaaatacagatcgaaacatttgttggcaagcctttccagggtgagcgtggggatcttgcaggccacggctgcagcgagatcatcccagcgctggaaagacgagaggagacgcgacgacgcggtgtcggagatgggactgggcacgggctgctgctgggagacctgcgacgaggacagagcgggattaatgccgacgcgggtctcccacgtggcgcttggcaggggaatgttctcagaggtccccagggaaggcgcaactgactcggcattccgttctggcagctgcgacacaggcggttcctggatcagaggcaccgcgttgagggcttcggctctcgactgtcgggtctttgggcctcgtcgtcccacgggcataaagaaggtgcaatcgatgccggctagttggcacctgctgcaggccgacccggtgaaatcgcactggtaacagatggtaagtggccccgtcttgcacctgttctatgcgaagttggggactcactcaccctcgccttcctcttccggcagcgatcgcacgcccggtcggacggcccacgcttggccttgctcatggcagacagtagtaatagtgcgtaatagcagggtctaagtcaatccattgtacatactcagcaatgcttgaaaataatccgatgtccaggagcatttggccgctcaaaggatcctttaatattaatctccagccgtatttccccgccgcctagtagattagggttagtgagtggggaagctttggtagaatttctctgtcgcgcatctttcccaccttccaatcaccgaaaattcattcgttgaaatgatggagctataccataactcgctgagattgcggagtatggggtaggatatactccgtcctccgcaccatgttttggctatgtatatagaccctgcgaaaggcacgcaatgtgcctgccagagagcagttgagtccattcatgcgttctgaattcggtatgcgggtgtttagggcatctctgctccttgcctgggcgacaaccgccacagcgcgtccagcgctgaagtcccgtggtacaccatcatgtcgctttgctctccagtacaaccaaagcgatattctgaacgatccaacggacttcatcatggatctgctgtattgggagggccgtttccaccagaatagcgtgggctataatacgctcaatggcatgtcgtacgacgggactcaaattgatctgacgaccggcctggcaacctcacagcacaacttcagtgctgcgagtaaagaggtcagtagaagtccgcagatatcccgagtggagttttgctcactcttttcttttttcccgcctgcagtcactccaggtgatggtttatgcccatgcgataaatggctcgcaagaagctgcccagttcctttcaccatccaacccagaggctgcgccagatatagcagcttctatcttggagacaaaattggctacttacctaaagttcaacgaaacctacccgggattcggaggctttcttccctggtacaataatgccaaggatacccgggatatctcgccgacgtgggactgggttaatcgcgttccagcattagacaatgggtataactctaggtctccatgttgattactgggcgcgagaagctaattactctggctaattactctcttgtgtcatgatagtgagctgttatgggctgtgtacagcgccattgaggtcctagaaagcagtcataatgactcatatcagcggctagcgcaaggctggcagcgctggctagactacacaaaaacaacagcagccaaggtaaaaacctttctctcctcccatccctctatctccatatctttttgcgccttttttcttccagttctgccagagctaataatgctgcactcttaagatcttttatgccggccaaggccaagtctgcgcagtcactgccattcggaaccaatcctggcctgtgaatgacccacgacagaactattcgtgcgcagatgacggaaggattaacgatccgtatgagggcgaattgttcacgtggtggctgcagttcttcggtggtctatctgaaaacgacaagcagatgctatgggaggtcaagagaccccagctagtgagtgtcgaatacaacatgggtggtgtaggaccaattactgtccaggaaggtttgtatctccgcgtgtatccatataattaacttctaatatgcgatcaggatattggttttcaggtcacgagcagtggaaggtgctcgaaatgccctattacgatgttgacatcattaggtagatatcgttcgctccaacttatcacagtccacgctgactatgacttcccccaaggcggctttacaacaacgccgaacgagctcgcacctgcaactcggttgtgacgaaagtccccggaatgttcgcttcagtcaacaattcaacggatcctagcacgggacagataattggctatatctccaacgctggaattccttctattgcaagccagactgtccaggaactggatgtcattactccttacagcgtctttccgaccttgcttttcgacaaaaaagtcggtctcgcctggtggaggaacatggtcattgctaaaaagatgcaaagtatgtcgatgcagcactgattccttgtggcataatataaaaatgaattgattggctgacctgtttcttcctttatccaaagatccctacggcagcaccgaatcctcccgcatcgacggaaccttgatctccggtttggtgacgtgggatagtaagattacgacagtcaacgcccttcttggcggtgtgtcggactttgtccgccagaggatgatcaaggatggaatttatcaagaatttatcgatattatccaggtaaggggaaatttcccaagtctcctttttgctccattcatgccttggctttggtactgtggtcgaagccgcaatactctgtctatcaccatcgcgacgattctgacaatcttctgcgacataggctgaatacacgagcgtcttcaagagcctgaaaggcgaaaatattccttactgtctaccagaggagaccattccagatcgaggattggtagaattcacggagtgcaattagcttaattggtcccatacagaagacagttctacctgtctgtcgatatgtacatataatttttgccaggactgtgcagtacatcgtgggacacctttaaattatacacatggcgttcagatccttgacatgagttttcattcaccatgatactgaggcatacgacgcgaccggcgaaaatgctatcgttggagtcctttaagatcatagaatcggcgaaagttggactggcaatgagtggttaacgcagtaagaacgacctgcacgaagcaatcccatgctctttccaggcgcgtgctcgagttggcacgccgaggttgaggcccctgagggttaccgaattaggcagctagccacctgcagtctgcagaaggagcggcccgcatagggttagagaattctattacttgcctaagtaaacgctgcttctccactgatcttctggctgttccccttcccgttctgagagcacgagcttgctgtcatcttagctgctccgagcccccttgcgtcgggagaatgtgacggccatgcaacaccagtccactgcaatgtccttctcaaaaaggaatcattgatcttgcagacggtgtctgaacatggaaataagaaataaatctatcaggaacattgaatgttgcctgcgtaccgaccaggtggtacgtaagtggcccaccagagcgcggccaccgcctgcctcccgggggcggagcacagcgcattcctgtcattcctgccgtcttcatatgtcgccttcatcgagccgaggcatctccatcgctccttcccagcgctaataaaataagatgttccgtcacttccgtgccacacggctacctacatgaacctccaagtcggccctccccgctctttctttgttttcccaaacctgctgttgtgtcgcttcattgcgtctgttcggcgggttctcttcttttccgatctggattcgtggacatagcccccaggctgcctagtcatcgcgatgccacaactgccaccacttccaccacttccaccacttcctgctctcacaggtgcgactacgaccagttcaaagattgaggacttaatattctgaccatggacccttgtctagacattcccctgcgaatcgcggctcctgctgtcgccgcctcgctagcctacctgaatgcgagatggtccgtcttctacgactggaacctcctgagcgctttggtccgaatattgctgaaatccagattggcggagcactgggaccgcattaatttgttctatgtcctggagaaacatgctctcgcttccagcaccgccaaccatcccttcatcgtctacaatggccggacttggactttccacgagacataccagactgccctgcgatacggccagtttttcaagaataagttcggggtcaagccgaaggaaattgttgctatggactttatgaactcgtccaattttgtgtttatctggatgggcctgtggagcatcggtgctgttccagccttcatcaactacaatctcagcggcaagccgctgacacactcggtcaaggtgtcgtcggctaggcttttgattgtcgatgaggaggtccgcgatcgcttccctccggagcagctggccacattctcttctccggattttagagacgacaaggggccggtggaagtggtcttctttacccctgacttggaggcccagatcctgcaaaccgctcccattcgggaagatgacagcgcccgaagtggtcctatcggccgcgatatggccatgttgatctataccagtggaacgactggacttccaaaacctgccattgtcagctggtttaaatgttgggcgggcggcacattcatcaccaagtggatcagcctgaagaagactgatcgagtattcacggtgagactccttttctccgtgtctgaaaacttgctagctcagagcactgacgtttctagtgtatgcctctctaccactccacggcggcgatattggccttttgtgcctgcctgattggcgggacgacgctcattatcggccatcgcttttccgcgagaaatttctggaaagaagtgcgcgaaaatgacgccacgatcatccaatacgttggtgaaaccttgcgctaccttctggctgtgcctcgcgaggttgacccagtcacgggcgaggatctcgacaagaagaacaatgtgcgggtagcttacgggaatgggctgcgtccagatgtctggaatcgggtcaaggagcgttttggcatcgaaaccattgccgagttctatgcttctaccgaaggggtctcgggacattggaatatatcgtccaacgacttcgcagctggtgccatcggccgaaatggctacctcgcacagctcctccttggacggaccatggccattgtcgaggtagatcatgagaccgaagcaccgtggcgcgatccgaaaacagggttctgccgccgtgtgccgcgaggagagccaggggagctgatctacgctcttgatccggacaacatctcgcagggattccaaggctactacaacaattcgaaggcgaccgaagggaaaattcttcgcgatgtgtttgccaaaggtgatgcctggttccggaccggcgatatggtgcggtgggatcacgaaggcaggtggtatttttcagaccgcatcggcgacacgttccggtggaagagtgagaacgtttcgacgtccgaggtcgcagagatcctcgggaaccatcccgccattctggaagccaacgtgtacggcgtttcgctgccgcatcacgatggacgcgcgggctgtgcagcgattgttctccgagaccaaaatgttgcgagcgagggccagccggctccggaaccatcagcagcagttctcgaatctctggccgctcatgcgcttgccaatctgccccgatacgcggttccattgttcttgcgagtgactcctcaaatgcaagcgacgggcaacaataagcagcaaaagcacaccttacgggttgagggtgttgatccgtcgcgtgttgccgcaactgatcgactatactggctacagaataacaagtatgtgcctttcgggacagaagattgggaaagattaaacgctgcgcaagtcaggctatagttctgctagcctaccgtgcttttttacattcgccttcgctctttgatcctatgatacccgagtctgagacgattcatggtagagtcatgaatcctaaactttgttctagtattatacattactagtcgtatatagttatcattatcagtcaaagcgaaagaacattcctacccgacaatagttccatagacaccagccaagtatgacgatcatatgcaacaagtcatgctttcacatgagcaaggttgccgaggttgtttcctccttaagtaatttcaatcggtaaaaatcaaactcacgatgccacgaatcactagcccacagacgtcatgaaacaattctagagatcacaaaaatgatacgtatatgcaaaatgggacgtatatgcacgaattgattgccgaagttcaagggtacttgatgtctgagcggagaaacatcgcccgttggaggagtatagcacactcaatggctgtgtctaacgtagggatccatatagtgatgttatcttcgtcagaagccatgttcttttatgttgacagaatgattggatgtgttaccccgtcttttcacttttgatactataaaggtcgtaactgtggtaattaaaactttatatacatgccaattttgttacttatataagtaacagtttcgggaagtacacgtatgtatatataaatgctgtttaagggaaaaatgtcacgactccttaatatccgccttcatggcgatgacaccgtcatggtcgtaaatgttaactttgctctcgtgccccaagtcctccagcacgatttcatactcctcgtccgcatacagcggactcgtggcgcggtacgagatactctgcggcactgatatcaacgaactctcatcatcatcagacttgctgcgttcttcctgccgcacatcccgccagagatcgaggatcgaaatcagattcaatggtccgtggacgacgatgttcttgtgtccttctacgtcgcgggcccagggcacggaatagtggatcttgtgtgggttgaaggtcagtgccgagaagcggaatagcgtcactggactgcggcagaagctgcgtttgtggatcttcttcttccccgcggatgatgggtcagatgatgatgatgatgacgctggagatggagcggaagtcgtctgttgttggttcggggccggaggaggagatgtgagagcttttcggaagacccagttcctggacagcaatttatctatcagaagacacacctaggaaaacaataatatgtatgctttcaggtcaggcgcaatactaccgttgatcgacaaccgcaacgccatcctcgttctcaaacgtcttctcgactccgacaacgatcatctcttctcccgtcttcctcaccactttgggctctgcgctcagaaccctcgtggtttccttgacttcctgtcccacgcgcaacaggttcggtttaccgtttgcgtctctgggccatcgcacctcgccgccagcccacatccgccgcgtgaacggagcgtcggggttgtacgaggtatccgtcccgtcagcaccgagctcgtgctcgaggaaagcgggcgtaaagtagacgaggtgatatcccggcggaacgggagtgccgttgggaggaggaggggcattgcgggagagatcagaagtgccaggatagagggtgggccggtccagcgtgagggaaagcagctgtagctgattggcgtcgagaacttgcgtgcgggtctgcggaccctgcgactgaaagcgggagaggaaagaagaggcaactgaagaggcatttggggatgaagaggcatcgtaggaggaagacgtgctgctgaatgtacagactcggctctggcatgatgactggacaacagtcatcaaccgagccaaggccggtctctttgacaacaacatggtgcggaatcctctctctactggagtaatgcaacgcagtggatgtgctggctactactgatgatgcaaaatggactcaattgacaaaagggacgtgatatttgagaaaatacaggggcccgagtcgtactcggagcatgctgcaatgcggagaagtaggagtggggcgtcggacctcgggtttcgccaactcctctcgaaactcggctcacaaccgaatctcgcaatctcgagaatgcagcatcgcatacactacagaatttcccacgtagctgatcgtgttagatacaggaatctaagttcgtcgtagatcgtagttccatgtttgatggactagaggcatgcacttcgcgtgtcctgctttggatggctttattgagattgagattggtggacctgcactgaatgtctgtcggggatgctggtaattctatagagctaagtttaatgtcacatagcagttaatatgccgtctgaaacaattgacatcaaaaagcctactactggggtgtcgttggaaaacggattaagatgcgcttgccgagattgcacgtggaggatccgtggatcgtgcaactccgctcgagatctcgactgcccgaggtcaactcggtctcgccatccctgttgtccacactcgctctgtttggatttattgataccttgcttctttctctcagtcttgaactcgacaaaacacgaataattggaagagttggagacgtttgttcaacttctaccgttcggtacactaacgagggatttcgtggtcccatctcggaattgggaggcagactgaatccgaagggacatgcatttagtccttcaaacagttccagaagccgaacggacatctcgagagtgatcgccacatccaagaaccatgttcttgaaatcatgactctcccatatccaacacccgcggcgggctcttctcctctccccgctatctcggtatcggaattgctcgcacgaggcaagccgttcgtagagttcccaacttacagcatcctcgacctcaaacgtgagacggacttgggagagagtgaaggaggtgcaaaatcatcagaaaacagcaatggagtctcgagtgctcaatcggcgagtttcgcggactggctgtctcgaaagctccagattggtcatccgtttgtcatcaaggggttcaacaaattgcccgaatgggacgggaagttgttttcgattgaaggattgattgagtgctctactcggaagagtaagtatctttctttctgttattctcactgagatagtaatcgggaaggctattgtcatccttcctagtatattgctctaactcttcctagatatcccaattagaaactgcaccactggtcgcgacctcagcttcacactcaagaagtttgcagatgctgctcgccaatcttatcgcgagttcaggaacttctacgcgagggacctgcaatgtccgccggaatggttggatcagtgccgcaaattgctcccaccggaattacaatacgatggtcgagcagatctttttcactggcttccgccttgtgccaggagcgaggtcatgatggcgtatgtaggctcggagggctcttcgtaagtggctcccaattccgtgatgcttgtgtctaccattgaccttttctgttcagatcaggatttcatcgctgcttctcatctactgttgccttgaatcttcttgtcgagtccatgggtcggtgtataccataggtctatttaccctggatctgcgactaacattgatactctgacagatcgcccagtcatctgctttgggacagattttgcgtcccaggtcaagtatgactcttttatggctgcaaaaggagcttcgccgcacgtggactggctgaacctcagccctgatgagctgatgaaagccgacttccccatatacgtatgcgaacaggaggtcggcgatgtcgttgttttccctcctgcgacagcccatcaggtttggaatgtagggaccttgtcgacgaagatggtttggaatatcctgcacccgctttcattggaagcgggtctcaactacgtccagcctccgttcaatcgtctctgtcatcctgacgttgcgcgaaccaatctctctttggcatgtgcaatgctcagcctggtcaaggacaagggatcacggtccctgccaccggatctcccgcttctttcccgcctttttcgtcagatggttcacgatgaatccatcgaagatactcctgcgactgaagttactcttgttcaaattcctgaaaatatgatagcgacatgcaacttttgcggtacggctatctggaatcgtcacgttcgctgcacagagtgtggtgactttgatctgtgcttgctttgctatctgagtggacgcagctgtgagcacgtttcgagttacagttgggcagaaatagttccgcaggagacatgcgacgaagtgatccgtcgcgcgagtgaaattctgcgatgtcctccggatgatattcgaaccagtaaccgccggaaatgtcttggaacggcggtcaatgatctgatgaaggcgcgacgaagcacgagcaccaaactttgtcatctgtgccggattgatcaccttgagtggaaaggccgacggtgtgacacgtgcaacgcctttttctgttttcgaggcctgtatcgacactttgatatgtatgcagcggatgtcatgcgccattcaggcatatggatgtgtccgaagtgcctggaaacgtgcaattgtcgggtgagtctttcatcgttgtgatacgagtagtcatgtccgatttcctttcttgctatgtttgactctcgttttaaattacgaaagcgtagttgcaataagatgactgactgcgtcttagtgttgccattttccgtctgcatacgtcaaggctgagaaaccggcttcgaagcgcagagtgaagccaatggatcctcggggtaagataatgggcttcacagacaatgtcttcgatcagaaaaaagtttgtctcgctgctagccaccatcatcctttgagcctgatttaacactcgacagagaaacctatcctcgacgacaactgcccactcggctccttcaggggaggagccaaggggacataagcgtccgctttcaaccgacttgacattttctactcaatcgcgacctctcccttcccatgtcgacggtgcaggtgacccctcaagtgtgaagcggatagcgtccagttctggggggagcagaggcggtccagaatccgccgcaagggaaacgagccctcatcgtcatgacgctgatatcagtcatgctggaagtactaccaatggatcttctaggcggaatcgaggttctgaggacagatttacgaactcgttcactcagggagaatctgtgcaactgccgccaattaaaactcgtggcatcgaactgccgtccagctcaacacacgtctcgactagtcacgatcccgctttagcaatgaatacccttgcaaatgcagccggagcccgggacagggtcccaatgactcaagttcaagaacagaggcttagtagcgaaaattcctaccttcctttaacccacgatcagtctcgtcgggagtcatctgatcatggcaattacgacaagggaaccaagtccacgtcatctactacatttcgtccggagtcactgacgactcaaggcgactctcattcccaatctcacgccgttagggggaccaactaccttccaccaatcgtgacagcaacagcttcacagccacccgcgtctttatcatcatcttcttcttcttctggaatctcgttacaaagcacgcgccaagatgagcttgccacgttagaatcgcagctccaccggcttcaccagtacgcagaggagcttttgtcattgtcgctgcaggaatcgcaccagttactgcaacgcgagatccagtctctcgagcagaggatcttgtcgatcaagagggaacggagtgagaagcttcttcacggccttgagagcgagtttcccggccttgttggagtaagagagggtattaaaaaggaaggttcgaagttgggatatttctgatgtctttgactaatgaatagaactaaaattcgacatttggtgaaagttcctttctatacgtctcttctactagctcactttgatgcaaagtctggagacaactatatgtgtacttttacccattttcaagatcacctcccgatctgaaaaagagggctaatggggaggctattactcatggcttgccattgtcagaaacttggtatctacatacatgtctctatacggacgtaatcatttaacatatatacacgcggattatacatatatataaccaattattgatctttttgccttttcccaccggattctacgcagatgagagactagaaccacaaacacaagcgtagggcacaaatagtacgcaatttatttttctatacttagcatataaatgaatactgaaatgaattaacttagttacaggtcaagattgtaggaaaacatcgttaccaggtattcctcccagccaatgaaagctctctattctgcctgctcaatttccagggcggtgtctccatcttactatattcagttaaactatcagggcggtgagccatattttctaacctaaataggaagttacacgtgatccagaaacctcgcagctggatttcgagcaatttgggggttgactgacctttccgctctcactgttcggtcaaaaagatttcggcaagaaagtacatgaaaatatgtacctctttgctcacatgacctgttgtcatgtaatgttgagtcttatctgcctggactccttgccgtgataggacatggtcatgtgacttggaaacctctcacgacatctccactctccctgtgtatgtttcatgcttctgtgggaggactggatttaactatttttcacgtgaatttgggatcttatctttctgctcactgcatatctacaatctcacattttatgttgaaaaaaaaaaacctcactggcagtagatagtttgtagttattacttcatcatatgtagtatttacagtaaagtcacatgaggaaggactaagaatccttaatcttctcttctctcacgctaagagggctaagggaatatatctaagcttgcgtgccctgaataagagttgaggctgctgcatacggtctccatccatgatatcttatcaagatcctcgatgcgggggcacagcttagtccatttcggggatagcgacggagataatgccggacaccgaacgacgacgtgtttgcctaagcctagatcgagtgtgcaaccaagcatcaaccatcggagatagccgacggaaatccaaatggtcgcccagatatatatgatctatgactagacagattcaatggatggcaatctctcacagttttctttgccgtcacggctttctgtcccttcgcaagcaacgacattgagtcccaacgacatggtggggaatgcatttcctgatagcgggaagatggaaggaccgtaccaaaataccagcagcgagtcctcgactgccatcgctccgcagaaggcgaagaagagaagcagagtccagttttcctgtacagcgtgcagatatcggaagtaagctctttcaaaggcacagcttctctgttgctgtcaatttgtggaacttgaaatgctagtcatctaactaattatatattcaagattgaaatgcgatcgaacatacccttgtgatagatgcaccagacgcggagatgcagcttcatgtacctatgttggtcatggaccgcgcgggagggcatctcacggtaactccagcccgacacatatacagaaccgcatccaacatctggagaatctggttctgtcctttgcgcaaaagaagaagcttgaagaacaggatacttctcagacccagcactcaatcaccaagcaaagtggcggcctgggagaccctgaatcttatctggaggcggaagaagaccgttcaaatgcggtctctggagaaaagaaaaccctacaggattcccctggaaagctcctggttgaagatgttgggacaagctatgtggatgcatcacactggcgggctatcttggaagatgtatgcgccataaacccctcataagacgatgctgatttctgataacgttgccagattaaagaagtcaaagaatatcttcgtgagtacgatgaaagctcagaagactcggagattgaacctgatatggacgactcatcccgtccctctctactcttcggattgggcaaacccccaagtaaagaggaattactggcagacatccctccgcgtcctgttgccgatcgcctcattgcacggtttctgaactcaggagatccttcactcggtaagtgtctctgcctggagagagagggtctatcgagagttctaatggaatatttccttgcagtgatcatccattttccgacgttccaaaaagaggtactagttccatagccacaatctggtctcggttaacgctttgatagtatgctcaattctggctggatccgcaaagtgtatcggttccttggctggcgctgctctacagctgtatggcgatggctgttgggatttactatcgtagtggagacccgttaccaagccccttgggtaattctttggagaccatgatcctataccgtcgacgctgctgtcactgtctcatccacgccaactacactaaaccagggcgttacaaagtcgaggctctcctgatgtatgccgcctcggaatactcgaagaaaggcaacgccccggttagcgtctccatcattctggggattaccatcaaactcgccatgcgtatggggtaccaccgagactcgaaacactacaaaaatatctctgtcatggaaggagaaatgagacgacgggtgtgggcagtcatttgtcagctagatgccctaacagcatttcaggtgggaatccccaagcagactcagagctggcaatgcgacacagaacttccgcgtaatcttttcgatgaagatttcgacgagaacacagcggagttacctccgtcccgacctgacacggagcgtactccagtcgcatatacgatttccaaggccagaattatgtcggtatttggaaggatctctgatcttgcgtactctcgcaagcctccttcatacgacgaagttctggagcttgatagacgccttgaagaagcgcacgagtccataaccccggcctttcgcatgcgtccgatcgatcagtccatcaccgatgctccggatctgatcatgcgaagatatacacttgacgtgttgtatcagaaggctcggattgtcctacaccgcaagtaccttacagaagttcgatcggacttacgacacacttactctcgctgggcctgcgtaaacgcggccaaggagattctacggcatcaggcggatctcttccacgagtcgcagccgggaggacggcttgaccgcgatcgatggttcttcacctcgctccaaaatcatgactttgtcctggctgccatgatcatctgcttggagctttcccagaacaagccttgtcagacgcagaccagacatccgggatacggcttctcggtggttcttgaaggccgagacgaacttttacgtgcgctggaaacatcccgcgacatctggaaagccaatcttcggcactcagtagaagcgcgcaatgcgtttaatgcgctgacatttatgctcaagaaagcccagaaaggtgaattggaaacaccggaaaccgattctagctccttcacaggaaagtcctcctatgatgatgtagcgatgggagaaagtgcatctactttgggtgtggctcatggtatgcattcgccccagatactaaatagctttaagatagtctgacctcgcatctccttataggaacaaaggagtcggagaacccgtactcactcggcgtccttccaacaccgggttcaaatggctcgacgactgtgataaacgatggcgcacagcccgcgactgggggacagatgcagccggcatctcttgacatcatacagagcatgatcgaggctcctagtggtctcgattgggtaagaatccgtctttgtcatcgctatgcagatcgccagttgctgattgccgattctctcaatagcatgtcttggatggccacatgcaagatttcgagccaggcttcatggatcaattctggggacttaatcctaatcctgcggcggccgattacgaattgcttcagtattcttttccgcaaaagccgggggagggaccacagcagccttgaggtagagtagagagtattgatgcgtgcaaattcaatggactgagccagggattcttttttcccttcttctgataccaatcgggcgtcctggttcggttgacgactgtcttgcttatattaagcccgggttagtgaaatatggatattaaaccatattagacttctctctctctttctttgtatggacgaatctattggaatgtcaaccttcaagaacataactgtgggaacacctaggaaatacaggcgatgtctgaggtgtctacatcctagaggattctgtctgtaaagacatgacgcaagatcgatcggcattctcaagggggagattggcacatccctgttcttagaatgagtacatgtaaatttttagataactacgagacagatgttggtgttctggacgtgtgcctcagtcgtagccagtaggaaaatcaagaaatggcaagttgttgatgctaaaattggatatttacattatcctgtgttaatgatgtattattattaaccactcagccgttgattaaagcagccatgctccagttactgatataagtagttgtatattgcgaacggtacgttccgaaccttgacgccagttcgggattccgcggccaaagagggaaagaaaaaagtcgggactccgaactgactccgaagattgaagctacgctactaacacgacactcactttcttcaagacattctctattattagtagctaataattgatatcgcattactgccattctgcgcgcattgttgcttgctatctacgtcattcaatcttaggacaataatttgttaattgttaatcctggtgaaccaaccatacacacgccgacggttcggcaacagcaattgccttacactcaacctggattgacagccaaggcaccaatctacctctcctacgacgacaatgaagtccctcctacctccttctcctcttctacggaggaatattcagcttcagcgacgaggtagaatcgtcatcgacccagtcccgcccacgacgacgacggtcaagcagcaattgcattcaatatcaacatcagcaacgacaccttcgcggtcgacaatagcgatctctttccaaagacgacgactacgacgactattaccagctcctcctcacacacaaacacaaataatacaagccaaacgatcgttccacatccctcaattatcctcctttttcccgtcctcctcttcctcttcctcgaataacaacggcagcaacggcaactccgacgacggccgcaccctccgcgcaacccgcacgctgcctttccccccagctccgctcttcgacgtcatcgcctccgtcgagtcctacgcggatttcctgcccttcctgacggcgtcgacggtgacggcgcgcgatccggcgacggggtatccgacgcaggcgttcctgacggtcgggtacgggcccttcagcgagacgttcacgtcgcgcgtggactgcgatcgggacagatgggtcgtcgaggcgcggagcgggggcggagtggcggaggatgggaagcccgttcctggtgccgatgaagggttgttcaactacctcagtacgcggtgggagctgatccccattaaggaaggggagcagcacaaggaaacaagagtgcagctggaaatccggttccggttccagaacccgttgcacaccgccatgatgagcgccgtggaggacaaggtcgctggcgtcatgatcgaggcgtttgagaggcgcatccgggagaggatgttgtcgaataggtattaatgcggagaaggggggttaaaaaagtatagatatggtatagactcacacctggtgtgatgtatgtatgtatagtacggatgttatagtatatcatcgacgcatagacatatatcgccttgcattgtcatcgagtcagctgctcaagatgattctggactttaggttattgttaatttgtttattgattcaaacgacatagataacaagaactgttacgcgatccaagtaatgattcagtataatacattcgctgaataacggaaatacccatctatcatttatttttacagcatgcccagactccgatgccttgtggccggactgcgcgtcaccttggacgcggacacagccttgtagttctcatacacggcctcccagttgatcctgttccaccatcgctccagatactcctccttgccggcgatgccgtagtccatcaaccacacatgctcccaggtgttgacgcacaggatgggctggatatcaagcgcaccgggcgccaggctcttctggttcgcggagtggttgcccatcgaacccgcgaactggttgcccagaggagcgtccgggttctgggtgttcatgtcgacgggctgtcgccgcgaatgggcggccgggtagggcgacccggcactgtacgtgcagacaatctgaaccaggccctcccgttccaggttcttggccagccagacgaatcctggaccgaacatggcgttggcagcggccagaaagtcctgcttcagggactctaccgaggagcagctctcgttgatctctttggcgaactcgtcggggatggggacggaggtaggagcctgcacgattctccgtcagactgaccgaactataccgacaattggcagtatttgtggatgcttacaaggcagttgaagaagaagtggttgttgtgagccattgaggcgtagttgaacagagctgccatctctggtcgtcgagcgtattttatcagaagctctccgggtttggcgtcagcgtccacggtgtctgtcgacagagaagattagagttgttgtccaatctaaacgaatatgccctacaagcaagatcttcttgcgaggctgcagcggtctcaccctgtgtcaagaggttgagcttctccaccagcagggtctgatactgtgtccaggcaaagtcaaacccctccggggacagcagttcgggaatgccattcttcttgaagtatgcatcgtgcgtcaattgcggtactcggtggaggcctcgagtctggaatcgtggcaggccggcggaggagggtttctaggaacggactgaatcagtacacagcagacgcagcattgcacacaagagtggaatgcctacattggcaagggatgagactgcacgcagggcagcctgcggccgtagaaggcgttgcaacatcctggacgacggggaatgcaacggcgacagtgaggcaagctctcgtatgaaactgatccgaccgcgcgcgctcttagaatttctgccgatgtttcccgtccgggactagcgccccaggcacggggcggagcggccaccggccaatcagcggcgaggagttcctagcctcagcggctacttggaacatccgcaagcagtcaccgtccattcacctgctcagcgtcgctctcgttcaaccgctggcctctagcggcttcgtttcaaagctaacagtttctaaaatagtcatccagagcctgtcatcatgaagagtcatcgtgttctgctgcttgcactcgactcccggttgtcgccgcatggcttttcaatctgccagtcggcgcttccacgctgcctattctgggacgtcggcgcgtgaatctaatgcgacgcttccaggctgtctgcacaatgacatctgctttgttggacccatatagaagggaattcccattgtcctaatgggcatttttgtcttctttgttcattgttcttcgctgaaagacgcgtcttgcagtgtccttgtttcttttctttcctcaagacgatttttacctctcaatagtgcttatagaatttctcatataattcattttataccaagactctttttcctttttactgaaatatttattctggctacttaattggcgtctttctcttcatttcgttgtcggtatggcgaggccaatgttgatcactgtcctcgccatacaactatccttgtcgtacctgcccactaccgtgacaggcagttatgtcccttttttggatctccttccacgagccaatgcagattgtcctgcttcttacacatcctgtgggaacagtcagctgccgccaaatttctgctgtccaacctcaacgacgtgtatcagcttggataactcgagctccgccatctgctgtcccagcgggagtgattgctcatttatcaagccgattacctgcgatatccaggcacagaatgctactgccaatccagaggcggccttgaagacgacgcgactgactgacagtcttccgaaatgcgggggttcctgttgtcccttcggatatacctgtcaggatggcagcacatgtgctctcatcaaagatacctcgtcggaggctccctcgtctactcagtcatccgcttcatccgctttatctacttcatctacatctgcttcatctgcttcagctacttcagctccttcagctccttcagctacttcatccactgcggcacctacctccactttgtcgatagttccttcctcaacgccgacatcctttgctggtctcgctccgaactcaacccagataacacaaacgtgtcccgcgtttcctgtgacagcggttgttgctggcttcttccctggcctggtatccggggctctggctgctgctatcataacgatatgcttaagacgacgaaagcagacggaaacgtcgaaacaggctcgtctccgccgccggtcgtcaggtggaacgattatcgatatatcggaccccatgccctcagacgtccagagtacattcagaacggactttcttctccgtaagggcagcagccggtatccagacagtgtcaggtcgaagtctatactgcgtcgaaccggaactcgtgtgaagagtttctttggttccaatccgagtcccaaactgaacgggggttcatcagatccttctccgcctccgccaccggtccccgtcacaccaccgcaacagatccgtccacgtcagcccagcacggagagcatcaaggtgtactctcctgcgagcatgcttgcgagttcaaacttgcgaccgggggttccgaatacccaaccagaccggccgaacacgacgtttagcgaggtgatggaaaaggttgggtttcagaaccaaagaggcgagccttattttagggtcacagagactccagcaccacaaagtcggagtccactgagaaacggatgaatgtagacttagatgttctcatactgctggggatactttgtaattcactactatagatgggttgaccttgtacagaaagtttctatcccacgctaggtactgggtaatttttaatcagcataatgacggggtcagttcatatcatataatctttgcaaagatagtaaatcaatatgtccctgcctccactggacaaaacgtgggcgtgcagtaccgaggtactgtgtttccatgatctggtactatttcatcaccgtgtcgttggcggcaaactttggctcgagaacccatcctgtcctcgacatgtacagaacaaaacagccaaattcaacagtacctgtatatcaaggtctcattgactgatatttctctctatctacggacgattcttgttaagttgttattcacatactcatcttcttgaatcaggcgacaaggtgagaaaaggaatcgaaaatgtcctccgatgccaccaggcccaaccccggcaacgtcatcaatcgatcgaacgacgaaatacctgactacgggcgaggggccgcacatgacaatcctgatgaaatggtgcgttatacgtgctcctcctactacacccttatagaggtaattaactgacacattatgaaaacccatccacagaagaacatctcttctctccaccaaagggcagcaggaggaggtacaggagcgcatagaaccagctctcgccccgcaggatcggacttgacctaccaagggcagaagagcaagcggaatcggagggggccgtcgcaacggcagaggcagcgaaagtcgcggtcgaggacgaggtcgacatcgaagtctaaaaaccggcgaacttgaatatcagtcttgacagtaaccggtagacgataacggaatggaaaggaagaatagtgaaaattgctgcagctgcacgttacgtatttgtacagtacatacagatgtagtgtacaggcacttctaagctctaagaaaattgcgcaaactttccgatcatatagcatcccttacaaataaatatcaagtctcaccacgtataaatttggcttcaatgaattgaagaacgttgcagactcgaaggtaggagtaatcgaagtatgtagaggcccggccttccagccaatcccgacgcggagaagcagagcatatccgcgtccagttgatgccacttcagcttagcaccgactacacctacagccagcaacgccgtctgtcaacgccgcctgcttccattttcccggcttgagagagctctcgaccttcgggaaagaaatgccttgacaatgtcgggcaaagatggaggcgtctcagtttccgcaaagcccaccgaggacgacgctcacaacgccgcaaccatgactgcggcgtcccgtgccagtcatgccctccctcctgagaaaccagaggctgtctggactcgaaccaaggtcattctggctttctggttcgtgattattttcctggggcttcccatgtggtggaaaacaacgtctatctacagagctcggttacccctacaggagatgatcgattgggcggatggcaaggtgcgaacctgactcgatgcaatccatacctgtgtcgtgatgggactgtggaattgacatacagtgatggatctttaggcttgccgtcccgtatttcccctggaaatcgtcctccggaccccatcgatgcaggtttcggaggcgcagaatctcctccgaacgactcagcacgcactcgatgatctgaacgagtttcctgcgcatcatctccgcctgaagcttgcagaatctcctgataatgttgagagtgaaaaagcgcctgttggtgacgacattcctgacgctgaagatcatattgagggtagcgcgcacgccgcgctggtcgtcaacctgcttcctcaggagaccactgctacccctagatcagagctgcactcactctcttcgcgcctcgatatatattacccaccaagccaggtcactgctgtgtcgtcatctacttcaccgctggtgacattcattgcgggtgagatccagaaattgttcaacgaggaaaaggcgaccattgcgcatatcctctcgaatgctggacaaggcccccagtcttctacacctggtgctcaagtagccgcaaacaatcagcagtcgaccgggaatgcaggcctcaattcgatctctcccgagttagctgacatcgtcagccggcgggtgacgagatcgttgaaatatgcagaaacctaccacctgacgttctcgctcttcacacccggatccgaaccgtcgtcttgggatattgaggcagcgatccacgagtatctaactccgttattagaggcattcgcgccaatcagcaatttctccgttgatacccaagtccagctctatgcgtccttcgccccgacgtcgccccggccggagtacgatgagtcgcagaagcaatggaccctgaaacaggaagacctcagcgcattcatcaattcagcagagtggccgctgagccccagcatcggcagcggcccaaccatcaatttcgttctctacgtgccggcgccgtcgcaatcgcctctggttgtcaagggcagtcaggcgacgagctggatcgtcccgcagtggggtggtgttaccattctaaatcctctttctcctgataacccatccaaccctcctcatcttaccaaagaatcgctgaaaccagctctcttgaccttctcacaccaactcctttctttgctggggactccttccacgccttcctccttacctttccgactgcagtctctgatccgcatcagggctgccactctcctgctgtccgcatcatccaccatgggctctctagctcgtctgaccaaatccctcccctcgatccccatccccgtcaccgtggcctcctccgtcgccaccacactgtcccatctcgccgcgacgtgccagctgctcaaagaggggcaattcacggccgccctggcgagcgcacgcgtcgcagagaaggaggcggaaaagagttttttcgagaagagcatggtcggccaggtgtatttcccggacgagcacaaggtggccgtgtacctgccgctcctggggccgatcggcgtcccgctcgtgatggggctgatcaaggagttgaagcgagtggttcgagagttgaagaagaagcagaggaaataggttaataattcattgtatgtgtactggtatatagagttaataacgattttgttcgtctttgtattctcgcgcatcacattgcaaccattaaaaggaaaactttggaaacaaaaaaaaacttagaccatgaaggcaatccccatctatgcataactttttttttagtggtacagtgtgttgtgaaaacaaatatgctcctgtaaaaaattcttgaataaaacccctgggtatctaccgttcaaacgccatcaatctatcccgtacatttgaaatacctgatcatacacccgacccgatcaaagaaataacccagcagccagcgtctcaagactcatcgtggcaataaatcaatatgagatcagtattccttttcgaagatcttttggatcggttttgcggcctagataagtaagacatcgaattagcagtgctcttgggtcaggtcacagggtgacgagcaagcaggcagcactcacatcgataaaccgctccagatcctggtccagactggccaggtcctccttccgcttcttgttctcggcgatcaacgcctgcttgcgtttgagcagctcctgtcgggcctgttccagcttctcgcgctccgcgtgctcatggttgatccgggcaatcatcagctcgtgcgggtcggagtctttgtgttcgggatgcagttcaaggaattcttcgacagggatcagcggcagttgtaggtatttgtggctgtagttcaacagacggttagtttattatccaaaacgcggcggagagggctctcgtactcgtaagactcgcatgccgcaatctctcccatcaggtgcttttgttcgtagtacaggttctgcagctgcaagtgcagtcggtcgatttcctgtcgagcttccgcagtggcctgcttcgtctctcgaacgcgcaggatggcatcccggttgaggccgcgaagctgggcaagcagcgagaagacaatcttctgctgcttggagatggctgccagagtctcctgagacggaggcgaggtggatgtgggctcaagcaacgagagaagcttttggcactctgcatgtgcctctgcgctggtgcgcaggaccggcaggagggccggatccgtgacaatatcgtggacagtcattgttgccattgataatgccgattgatgtatctaactccgttccacttgtgcggtcaagataagaagaggggcagtttccaaaggccgaacgttggtgggcgaagaatgcggaggagagagtttgtctggaccgcttgttcgccctcgtgctcttctcagagatcgggcgcgtggagggttcggcgtcgctgacgggtcaatgaagaaatgtcaccagcctccggcccgcctagtctttgtctagcggcggccagtgatggcaagacacagcgatgatcgtagggtcccgcagcgtgggttggctgggctggagcagcgatcgatgcaccttgcgaacggatgctggcgagcagattgtccgcgtgctgggcagccagctggaagttgttgggaaatctcgcacccctcgcagcccggcacttagctaagcttctcccctcccgcatcgcaggcagtcatggcctccgattctcctttaaatagctcgctccccgtcttgtattcgttacttgcgttgaactgagttgagtactaccatctccatcttaccttgtgtcctctttcatattcgccatttctgcccagctacttcgacgccgcttggaaatatctgccgcaacaaaagtccgggaagcgttgggtggagtcccggaaccacttcctatacccgagtccacaacacagcaggataaaaaagcatgacattttagggaagaagagagaaggattatcagggtcttttgacggtcagaatggcgtgcaaggctccgtcaatgaccatcgagtcctatccggacgctatttccacctcctgttcgactcccaacgaccagacgcctcttctgcgcgatcggcgaagaagacattctttccagacgataaggcgaacctcatgcgactacgatgccgacgcaatctttctgagggttagttgaatgttgcgtgttcgtctcttccgtgaatcgtccccccgtctgacgtggtcataggtggagctctttcttgtcgaattggagagacggcttcaatggttggaagaataccggaagtcccacatggaacaggtcgatgcgagtttgaggagaggatatgccgcgttggaagctgtgagagactcatgctgtgccgcctcgggggagctgatgggcggtggtaagaaacgggcaaagattctcgtcgaaaccctggaatcccgatacaacgaagctctcgcgacgaaggagacactcgagcaaaaggctcacgcaggcatgcgactgatggagtccttcttgagtgagatcgagtctcgagtccatgccgtccgggacagaggcctgtccggagcattggacgagggctggaaagcagtcgactcgggtctgacgcatgctcgggaagcggttggagaagcggttgatgagggtatggagcgcgcccggcgagccaaggacgctcttcgcgaaagcatcgatcgtgcgatccagctggcgcagaagaaccgtctgatccattactccgacctcccacacccgtggagagtgaacccgcacatcctgcaaggatatcgtttcacgacctcgaaggtggaatgcctggcgtcgatcttctccttctcgaacgagttggtcaacatctggtctcatctcatcggtttcttcattgtcttggccgtggctttctacttctacccgctcaaccccaacttctctctaagcaccaaggcggacgtgatgatcgctgctgtgttcttctttgcagcttgcaagtgcctggtctgcagcaccttatggcacacgatgaacggcattgccaaccaacccctgatggagcgcttcgcttgcgttgattatactggaatctccttcctagttgcggcttcgattatcaccaccgagtacactgcattctattgcgagcccacgtcacgatggatctacattcttctcacactatctcttggtgttggcggcgtgatcctcccctggcatccgacctttaaccgtgctgagatggcgtgggcccgggtagccttttatgtcacactggcattgaccggctttgcccctctggctcaattgagctacacccggggctttgagtggtgtctgtacttttacgcgccggtgatgaagagcatcctagtatacttccttggagcgtgcatctatgcttcccagatcccggaacgatggcgccccggactttttgactattgtggaggcagccacaacatctggcatatagctgtggtggggggcattctgttccattattgtgccatgcaggatctctttgcgggcgccttccagcgagctcaaggcgaatgcccaaccttgaccaggtgatttgactggcatattgctgaattcatgagtcagcttacccttataccctgtagatgattgaccctattgtcgtttgttttccctgtcttgcacagaatcgacaggagaaaaaaaacacttccattctgcaattatagttatggcaagcgcatttgtttacggaccggtagtcttgagacagttgagcattttgtgtcccttaaattagacgagcatttctgattgcatattcctggagttacgtgtctcttgaccataccatgttcttgcttcttgtctaagtcaatatcatacgattgccagtggcaattttggatctatcaacgagatcgtacttactacctttatgtaagtatcgattgagtccccgaataatgaaagtagcacgtattcgatctctgatgagagacatgcttgctgttttggccatatctgtccgccttgatcatccaggtcaacctatgcaattttctggtcagaggctcgtcatatgccacccgcttaaagcgcatggcttctcccaggagtagttctttgaagccgtgttattttatttcacagcggttagcaaacgagagatgcagtcgtgtataaaaaattgcctttgacttgctattccggggttcgtttccctctggaattcgcctgaataaccgcgtcacgaatctcctcttcctattcctacgcaatgagattttcagcgcgtcgagtatctctccactggccgggtccccgggatggggtgagcaattcatcctgtgcgaggagccactcaagagtgacttgtagccgtctcgtgacttgacgacttccaacgtcttcaccatctcgagtgctttctggattttttttccgcctgtgacacgagggacgttcttacggaacggatctgtcagttcattgagattcttgatctggccggtcaagaacccgcagcccagggagctgtacgcgacgacagccactctcagctcacgacatgtcgtgagcaaatccaaatgggattcttcaatgtcctgcgcaaaacgactgtattcaacctgcacggcggtgatggagtgtacagcatacgcccggcgcaaggtcacggcgaatcttgccctgggtgcgactggggagagaagttagcaaagcacgttcctgcattcgattaaacaacaaaatataatgcttcttgatgacttttcggttcgaccatcgcggcgatagtttcagccccttcaggctcctctcacaggcctcctttgcatactccggatcgagtggcatacacgcggcgatttcctggaaggtgctcgttccgcaatagctgtgcagcttattactacctccctaacgggcgtaagataacgaaaaggtagaaaatccacggtattgtcaggcatagtcactgaatcacagtggttgtttgttttcctgatatagtaagcgcatgttgttgccaaattaaataaagttcagcgggtgcgggaagacccaccgactactcaagacccatagctctcgtggattcagttaacccgaccaactagtttagtttcccgaccattcttggcaaaagtcatgtgatcagattctgctggatggcctgtgcctattgcctggccttaataaattacaaaacataggatttcaatttcatttaccataaattacaaaatttctatatactactgttacgaaccaacaggagacaacgctgtccaacacagcgatgcaggatgaaacaattacctcgcgaggcagaaactacacaaagatataccatcagggatcacgtgacatggtataagtataccattcagatataccaagaaaggtataccagaaaggccccggaagacctcgacggcataccgttgtaaggtatacacatggtatactcaggaggagatataaaaggaggagatattccagtcatgtatctagttctttccttactcgcgctcaatttcaatttatcaagatcattgttactaagatacttactttgggggtcaataagacttcttactactagtggtatacttcagtatagctctagtaggcgttgcctctgacctagtctttattgttatccttacctactacttgttgtgtgtccctgcgagaccccactatatctggagagagaggtcgttcgaggaagagcccttcgccaggtaggccgttgtctcaaggagaagagacccgggtcagttagaccgtcgcgtgctcgtgaacgacatagagtcaggaagactccttgatccttccctaaccaccactgttaagtatcgacgactacggttggacccagccaggtaaggccgttgtctcagaaagganacccgggtcagttagaccgtcgcgtgctcgtgaacgacacagagttaggaagactccttgatccttcctaaccaccatcgttaagtatcgacgactacggttggacccagcgcgtaacacctgtattgctcatgaataaagactgggtcatcattggtctacatggaaataataatattagttaagtcacagtgtgtgaacatatgcttagcccgtttcttgttcttaataatatcctccttaataagggtcttcctaatccactttttgtcattagaatatagtgtgaaacaccttgtctgtaactacctatatagtaaacatcttctgtgaccttcttatcaaaaatggtcttagtaacataagtaaacctagtaaaaaattgttcagcaaagttcaatatagaagacatagtgtgacgatccgcagccaggtgtctcgggtgagcgcgcacgggatgttatcatgtgggcggtgaggaaggcgggaacagttctgcctggcagtattttcaatatttccctcctacagacctccaacccctcctttccttccttccccagcttggtctcttgtattttagccacctcagactactcagataggaatgagattgggttctgtcacagttagccagagagagagcattccttgggtagagaatatataataatgaatgaagtccttaatagtggctaaatcaggtgcaggtgttatgaaccaaccggagacaacgctgtccaacacagcgatgcaggatgaaacaattaccccgcgaggcagaaactacacaaagacataccatcggagatcacgtgacatggtataagtataccatccagatataccaagaaaggtataccaaaaggccttggaggacctcgatggtataccactgtagggtatacaaatggtacactcagaaggagatataaaaggagggaaaattccagccatgtatctagtctttccttactcgcgctcaatttcaccttgttattccgttactaagatacttactctgggggtcagtaagacttcttactactagtagtatacttcggtataactctagtaggcgttgcctctgacctagtcgttgttgttcttgattatcgaagcaccctatcgtgtgtccctgtgagaccccaccatacctgtgagagaggtcgttcgaggaagagcccttcgccagttaggccgttgtctcaaggacaagagacccggatcagttagatcgtcgcgtgctcgtgaacgacatagagtcagaagactccttgatccttcctaacacattgtaagtatcgacgactacgtggaccacgcgtacagcagttgcctttatagagacaccccccccccccccttgacttgagaactgaattttgatattagcgatttgtgtacccacaacattccaggagggggaagagcggctgtgtctcagctgtcacatgtaacagtactgtaccctccagccacacctaccaacctaccactggtgtctgcatgtatgccaatcaggtcatgcaccctatcagtgatgattcaccttccagaagtactcagctcactaagttgcaaaaaaaggatggtggaaagctccagcacacttaccttcttggcagcttcacgtgtactgtgatgtcaatctcaggcttggaatgtgtcatgagataatccctaggggcattccaagcagagagaatgatgcaggcggactaatctctccgtgtgagggtgtgcagaaaggtgtgaaagaaagagaacacgggagaagagagtgccgttcacagtgttgtaccagaggaaggaaggaaggaaggaaagagaccaaaacaatgaatctggaagtgtcagaagagttggaagaacacgcaagaggcagtcacatgagaaacgctgcacatgattgtttcgtcacacgaatgactacacagacgcaaccttgactaactgaataaggagtttttttgacttgcaagaagctccggtgtctttacacaagctgtctctgaagatgggaacagttgagctttttcctgattctaatctgcggattcaataattttctctataattattttgataccgtgtctgactaacaatcgtctcacagaaagatgtattcgaaataaacgctcaaatttggttcgaaaaggaagctgaaaatagctagtttcactagtatatacacgtgcttgtggacgcgattgtggacgcgattggtacctgaagaagactacttaggggaagaaaaaggcccggtagacatggagcgtaacaagatatgcttagagaacggatcgcgctttttccccttctgtctggagagaagaataacagacaggaatcatagacgttgtatctatttatcatgacctagttcgtagtttctttccgttgcttttcttaaaccatccaaccagtgtatatacttagtctattaagttcatatatacatgccaggaccaccaggaagaacctaagattcgccgtcgtcatcgtcatcgccattaccatcgccattgccatcgtcggatctcttcactaagccaaagaccatctttggttccgacagcgtatcggcgaaacagatcccttcttccgtggcccctttcatatcccagcagagaatcttcacgtcgagcggtttctcattgtcgtgttgtttcaggcctgtagctgctgccccatctccattcttctcgggcggcagcttctgcgtgatggcgatgatcgtgctggtccccgcgtaggtggcggtgggattgaatccttctgtgccctcttccacaccggtcctgttggcaaagacgaggacgactttcttttcagattgcgtcattcccgaccgtaagctgctaccgccgtcgatatcgccgtcatgagccatccttttctcgatcagaggccagaacctccggatccagtagttgaaggtatccatatctggtcgattgcggcctagggaagcaatggcctcctgtccctccagggtcaaccacgccgtcgagatgatgaccagctgggattgtgagtcgaggacccggttcgcaaactcccacgcggtgaagggggcttcgaaccggtacgggttgatgtccatgcagatgccgaatgtggtcggaacctgctgtcttgtagcattatcttgcgacggcctaggagagtcgaattcgagagcgtgatacccccagccaccgtcaccctctgatgcccacgtttcgtcagtgtaatataggaattgcttccgataattcagcaatatctccccgttctcatcgacgacgagtagagaattaaagtacttttctgtctctgacggcgatggtgcttcgtcgccatcaccatgccgcacttctgctttggaaatctcgggatagcccacacagactttgcattttaagtattttgctgtgtctcgagcccattttgctgtgggtcccgtgccttgaggctctagatatggtttgatagcctgcaaagatgggaaattatatcctgttgaccgggttagacgacatcagagagagggagaaagagaaaattgcattattgcagttcatataataggggagtcctcacctgtaaacgccatctccggcaacaccaagatatccggccgcagctcctcaatacccggcccaggtccatcctcaacactgctcaactcgtcattctttgccgtagcagtagtagttgctgctgaccgcttcaacttcaacaactcatccgcccgccgcatattcccctcgacatcgcccaaccggggggcgaactggagcgtggcgatcctcattcctctgcagtgtctgcagtggtatttgtattggtgttggtgtgatacaactaacaagcgtggctggctaggtctcctggacctagagctctttgaagggaatggacaagtaatgccgcaaaaaggatggcagacgtcgtagacgccgaaagagagacttcttctccttccgctagttatgagcctcggaggtgatgatgatgatgatgagaatctgatatgcgacggcgtgggtctgataatggatagaatattacagcatgctgctgtgctggcagcaggcatacaaacttatgtaactggatgtagcgttgtttctttcaatattctttctttattcaatcatcacccctagaataaagggtcaaccggcttctgtcttaaaattcccaatttctgttgggattgaacttggaaaaggatataatctcataaccaagagatggattttcgatctgatagattgatggtttgagttgtggttgatggatacggaatcgatattggccattggctggaccagataagattatcatgtgatcagtgcaccatcatcatcactgacatcaaacattattttttgacgagaaaatatcaatatgaagcatctatctaacgtacatgtatgtacatttttaattatcatgagagtcctgaactggaccatttcacaagtccattccattcactcctctgtatcgaaaacctcgttatccagcccctcatctgtgcccatttcatcccactattgtgttatccttcatttttagacaagtctcacctatttagagactttagaggatcaggcatgtaactgatagaacatagcctttttttttagtaaaaggaaaatagagccacgaggtcaggagaatatcaaacctgtcgtgtatgggatcaacgctcagaggaagtgtgttttttgacgcggagcttccctttagcgattcgctttctactcacgaattaatgactgatgtcagacagctttggcatggtgtagtgctcttggaattcagcatatgacgtcccgaaagcaggaaatattgttgaaaatgagtaagcggacgtgagattagccgcttccgcacggccactcatgctgacgttcatgtttactgtttataccgcttgaatgagggaaatggctgaacttcctgggttgttgtagtctccacaccttttctgagagatttcgaagacatttctgagtgatgacaagatcttgttctgagtttattgtactcgggcgagtccgtcattcaatattaatgtgaagaaacaatagtcggccgggcagatgtctcagcagtgtttccactttcgcgaggtttttgacagttttattatggtcttcttaagacgagtcactatatcctatctgtcagtatcactcgttctttttcatgaatgaaagtcaacaaaagaaggaaaattatgctcactgtctgagataatgtgatagtttccaggctgcaccaggttattgtctcacttgtaaactgcattcgtctctcaaaagttaaacctgggggggggttcattcgctcattactttggggatccttcctgtcacagcttgggttccaggcaagctcgtgtagtctgattggggtattctcgagaattccaggcttatccttctagcccgaccgagtgctctccaatccccctgaaggcagtggatgctctccggcccacagtgcattgattgacacttatataacaccgcttatcagctatcagggactttaggtcgagtaccacgggaacgacaagtgaagtaatatttccctttattgtggcgtcctcttctgacatctttaaaatttttcttgtgtttccgtcagacggacatcatatctctgtatcgcgagaagagggatatagtgtaagcttttctacacgctgccgaatagttagtttgatcattcctcgtgcagggcgtgtttgatgcattttatatcgaatttgatctcgttttcaacctgcgtgcttcgtgtgccgatgcgagaatgggaatccaccaccagggtcttccagatcgtgtccgtaggagaatcctcgcgaggtcctgcggaagggtagttgtccccgttgttagtcttaaaaggggtatatgtagaagtacacattgtggcaggaggaaaccccacgtccaaggccaggattattcggtattcttctctgccgaaaggggctcgttgatctgtaacctgtcccaaatgggaattctgtttatcgtaattcacgcctccagttatcccggcgtcccacaaatgagagggttataatggatccttatttcagtcattgctgaaagtcgaatcaaaagctcaagctccacgcgttctgccgcatggactttccataatctctccaatgtcaagtcacagtgaacacggtatcatgaaactctagtcccagccacatatttctctttcttgcttttatattttcctggaaataatatggcaatcatcaaaacttcttggtaagctgtgaaacaaatgtcaatgttcatcccccttttcgaacatagtatgacttacctgttcggcgaagaaaactctcctatgttcctttaaatccttgatcctatattgttcttcgagttcttatagcgatagtcatgcattcccggacctttgcttgagccatcagttttcatgttataggccgtcgtttagacgtttcctttctatacttcgaacttcttccagcaaacttatggggacattttgaagcttactcagtttgagagctttatcatggcgaaggccgtgtgacatagaagaaaagactcctacatcacttcgctccataccagcgaagaggacggcgtcggcaacaacatctccatcatgcgcttcacgatccctgccagtaattgactcatttatctcttgaaagtgtaggtcaagttggttgacttttagagcaacgcatcctagcattcgctgactgctggcacctggcatcttcagcgttaatgcctgcagacagatcagcctagctgcgttgacagtcacttcctcaggagttaactgccactggctgactggaaagaggtgaacttggagatcaagcgctggcgctcgagatggttgagctttgcgtagaagacgtgtgcatggatcccgcacggtcgcaatgcagcagctatgaagaactgctggatgggcatggtgcaccaaataatacctttctcgttgaaattgcacacttcgttcaccgcgttggggaaggagatgacgaagcttcggtgccctttatccattctggcaatgggcccgactcgtggagtctccttcggagggtgtctgtcataatgaagatcactatcaccgaatggcggtttatgcgcgttggaattgtgattgtctgttgattgtggagggctgcagcttcttttagcgaccatttactgagcgaaaatcctgcggcatccccgagcctggccttgacagcaagtgaataaatactatactgcagtcattatgcgtcccacatcgttctggtggcgggcctgctcttcagatagatggtagatagttgggcttcgcggagtcctgtggtaacaccagtcgttcttccgggaagattcgagtaaggacatcgtgggagtctagaaccatactccggagcaacgttcgcattttgagtgtaaaagcttggcttttccgtctcagggatcagtggaggcatccacaatcgagatatatgaagcatggcttatgcgtaggagaaagaagtatattcgtcgaaggtggacgcaactgataatataatccaaaaatacatcccagcaagtaagtgctcaagaaatgggaagaaagcaaagtatagacagtatcatacctggttggtgctttgagtaagtaggagaaaggaaaaagagggaagaagccgggacaaacaggatatatattccccggagctggctggccagtctgtgattcaccaggaagtttcgttcactgtgcagacaaagaagtcgaatttacttcgtaaattttgcaaacgcagtcactgctctgctgctataggttgactcttcacttgtgccttgtctataggtatatgtattcttgattgcgctccaccattctggttaatcttctacctacctaacttgttgagttactaggtctgtgagctggcgcagaaacattgtattgcattggtaatatgatctcactttctgagacctcaggaacttggaactctgcccatgtccttcctttcatcttctatgccacgtgtgcaaatactcttgactccccattgctgctgttctatgtttgttgggggtgtagggaaggaaaaggactaagcgagatcgcctgtttcgtctttcttcgtctccccaaccacctcttccttgtgtcaaaaagatcctagtactcgaaactagcgaatcctttcacaaccagaaagcgatctccatctgccagatatcgccaggaatttcatgtacggtttgagattgcaattattacacaagaccagtatcttactgtatctagaatacattacaggaatgacctgatccggaaacttagatcccggttctatgtaacgtctggggcacgggctccccggacagacgttttatttcgagaacttggggaattctaaagtcaggggtataataattagtttgcactgaagccaataatccaaagaaagggggaaaaaagaaaataaaagaaaaagaaatccccagacacagaaactgtccggggaaagcaggacgatggcagatacagtgcaattctccaatatgacgacggccttcccccatccttactatcctttgggcgtagagcttcctggatacctggctaatgagagctctgttctatcacttgttggtcgcttcgctgtttgctgggtgactgtcctcggcattgcctttcttatcataaaccgtgttcgaccttcagccagcagatcagatcgtcttgccttcctgtggttttgcctgagtaggtcttttatgtcaagccattcaccatgccaagcaactgaataccaaaaatacagctgcatcgatccatctcttcttcgaggcctacttcgtgctcaatcatgcacatgttgcaggcgctcgtgatcttttcggccagctatggaaagaatactccctcgccgactcgcgctgcttgacctccgatacgtttctcgtgtgcatggaatttgtaacagcggtaggtcaaatattttactttatacagctgagtcatccatcgggctaaacctgcctgtctcttacgacaacagttctgctggggccctcttggattgctcgtagcgtactgcattgccgttcagcatcccgtgcgacatgccttgcagattatcatctctctcggccagatttacggagatgttctttactacgccacgagcatgtttgatctgtacaacaatggtgtacacttttgtcggccggagaggtactacttttggttctattacttctttatgaattttatctggattgttattccttcgtgtaagtctttgtgttctgcaaattgtctcatggtcgttgctgatgtgcgtctgcgtctagattacttggtgcaaagtgttacagaaatcgccaatgcttttcggaaggtagacgagtcaagagcggcgcggaagtcgtaatgattgtctttaaataatggatatattctcataccatgttttgtcgacgacaggacattgtgaatgcttcaagaatagacagggagaggaaaagtaaatgtcaagaggccaattttgtgatctaattttgtaaaagggatacctttggatttcgaaatattgccgaactatcacctcaatcttatatcccagttataatattaatattaatacatattcctcactagtaataccaaccaactccactagtttatctaattacagtacaactacatacatgcaacaacaactactactgacctaactactggaccatatagaatggtggtatattccaaaggatcttattcagttttcaacacttttcgaagataaattgcggcttcttttcccaaacaagcagaaatgatctgttcaagtttacgtggagacctagtatagataagcctgcgcagccaccagttacacatttcgcatcttctatattttattgtcatggctgcctcttcttctatcatagaaaataaaaaaaggtcctgattgacaatacagaattcggtgtttattggtattgtcgtaaccaggccaatgattgagtgttttgattcacgtgcaaataaagaccgggctgcctagaagaaagtcgacgtcgatgatctcctctggtccattccttccttcttcagcctcagtgttatttgcatcgagtttttgcagacagaattctgtctttcaaaaaagccgttctgcttgcccgagctgccttataactgtgctctttccagctgctgtgtgctccaccgctcctgccccttttctctctcctgctgggtccagcaccctagttctatcctgctttctacttctgcgcttgtggtttccactgctagatctttattagaaaatcctagttctgattttgtctaccttttcgttgctctccgctcttgcaattgaaccatggattcaactggacgttcctttaaccttgcaaggcaacggcctgcaaaaaagcgtcggagtgggccttggcaatgacaagtaaattattcaatgaccagaaatttattaaaaaatttgacttgttagatgcgatgagccacttggtcaaatatcattaaatttcctttgcgagtaccagactgtcctatccttcatcttgaagagcaacacaaccagaaacgcgagacaatttggtttgaaactatcgagatgacggaatggttcagcgatgaagatcttttctgcggtgcgtgtggaacaaaattctggctagataagtcgtatgatatctggtatcgattctatcgagtcggtatgtttgacgattcctaacttcccaatcaatatctttccacgaacacgttagaataacaattgcatgttctaatttatccacttaagtcattgtcgaccatgccaaagatgacgctgaccgtgaagtcttcaccctctctggaatcggtgcactctccgagggaataaaacgagatcgactgtacgcaccaagagaagagaacgagatcgttaaagccgcacacgatgcagggtaccttggtgccatagcatccaatgtttgcacaatctatcctgcaagatactggagctcccagaactgtcaaaattatcctcacggctacccatttcatgcgaagtgctggatactggttgagcgctgtctaggcctaggctatattgctcagcaccaactcgagcatctaatcattgcgatccggaaatattggtataaaaacaactatgacctggacaaatatatgcccctcagagactatacctgcccatgggtcccttttgtgtgttatcgtctagtggaagcgctagatgtcacttggccataccaagtcaacccagttgatatcccggaagtgaaatggctgataaaacaaagtactcgaacacagagcacaccagtgaaaacagcaaaaaatcctcagacctgtgacagagaaaattatctctcactactgccattagaactccgctcactggtcctagaatttcttgaagacatcgatgtcaaaagctgcgtttccgcattagggtggtccattcctgaatcccactggcgtcgacgattaggaggccttatctttgagttcatggaagttcaatgcgatgtttatatcaattgggagtttgcatactttgagacacaacaactgctcagaaagatcctgggtctcgaaaaccgtcaacgtatttggaaggctctgggctcagtgagaggaatttttcagaatctcgaaaaggaagaaagctcaacccgtttatctgtcttcattaatgagacataccctatctatacaggtcctattgatcctggtctgaagtatttcaacaaacatgtgggctgtgcgaagccgtttccacacacgagatttctcagaggggatccgccaactaatgagcgttgtgagtgtgaaaagcctttgagctgaaatctgatgtgaattaggattttcatttgttattgatttttctcgaggactcgctaatgaaaaatgtcgttccgcttgtgtagtcgcctgcatgaaaattagagactgtctgcaaacaggatcagttttttgctggggaagaacctttatcagcagttactgaccatactacttggaaagcttcttaaagaaatcgctaatatcctttgcctcaggagtatcggcatcaatccaagccaaatcttgtggagcgctacaagaagtccttccagacctcgttcgcaccctggacttggcctcccaaaaggcggctcttgtaccgtaacacaccatgcaccaaagggaagtgtatcccattggcgccatgatgtattcagaacagtaatcctcaacttgtttgacggctaattcccggtctgcaggcgtgatctcggcacgtttgaactccacatacagaacgtcccgtactgtgttgcgagtgtcgtcccaggtaaacaccttacagtcgactctgcgtctgctctcatccgacggattctgttcctgcacaaggtaaaattgcctagtagctgggaactcgcggtgcagaattgccatccagaactgcgcagtcttggtttccaacccgctccggtccgcggcgatgttgtagagatacctctccacggggagagtgataagcgacgtttcgaaagaggtttgaagaatgtctattgatgaatttgttaggagagttgtatgggtagagtgggtggagagactgagaggagagactgaggagagagattgaggagtgtgagaagaagaaaagactgagaagaaaacaaagaagcttcaatctggaaggtgaataaatagcactccatccatatgtttctttgttgacatttcactgtcaaccaatgttgtttgtcgtgacaaacacacccgttatctgacctgggcctactacacgttgtttgtttacggaagaaggcatctgtcaaagggaagatacatgcacagctattattagatattatctcttcttgcaatcccaaatctcgtatttacacatcttgacctttttttcttgaggataattaatagccctgaacgccattcgctggaaagttgataagtgcttattttataattaggtcagtgaacctgtaaatcccagcttgaatcactttactgtcaaactccttccattcaagacaaaggcttacttacatcacaaacatcatttattagctagaatgaatctaggaagagccatctatggctgtggcagatcaggtggttttgagaaaccgtcattcgactattattcaaggtcaaataaccgttttattataacatatgttagaattacaataaaatggttatataacagttattttctatatagttagaacagctattctacagttagtaattaagtattgtcatattttgttttttaaaaaaaggaaatgttacttaaaaggaaacattaattttagaagaaattatccatttttttataaatggttttttcctcagaatattaccttatataaatgtagctccctacaataacctcaaaatttagtagtttagatagatagtccagtggttagatagaaattgaagcctcgttctccttttgtagcaacttaaatgccgtatctatatgtcttagctatggaaatggaagatgcttgaccgagatcgatcgagagagctccaacctatgttgtgcagtatgtacagtacatggatggatgatccttacacatgccgtcctaaatgtaatcttataatgtagcttagtaggtagattatgattgattatgattgtagctcaagtcataccataggcagagagagagagagagagagaaagatgaagcctttacctacgtagtaaaagagttgttaataaaatactaagttgttgattactttcttttttacctaatggttaatttctttcttagcaacagtctgatatgaagaactttttaaaataacgtttttaaaaaaatgctaaatgaccgtcgatcgatcgactgtttctaaaaccttctttgatacctatggcacgggtatattggattgggaaagtctaagtaaccgaaatgcactgcaccaaaaaaaatatacacttcctggaggggagtggcctgcctacccataattaggccccaatggcccccctctccctattgatcgatcgtcgtggtgatatacctaggtatacaaattcttgtggaaattccatacagtgagataggggtgagggacaaactacctacctaaactggaaggcataccttaattcacaggtatctaggtacctatgtacagtacaatacctagggcaattacataatgcagaattaatattcgcaagaaaagaagggcgtcgtcgactcagtcagtcagtcaatccaggactgaaataatattccaaatacagtgcttattagttaattttaattaattgattgattaatttaattgctgataggtacctatactatacttattgctattttcggtaattacctgcaggttaggttccagttccggccggacggacggacggacggatggacgaaccgtgggttcgggtcgggataatttcattgaatcatgaatgattgactcccggacggacatagagacggcccgtcattgttattatcatagtcatcgttaatcctataataataattaataatagattagatttggcagtaatgtaatagtatctattacctaggtaagtagattacatattagtacatacagtacacacatatagattgactgatcaggaaaggaaaggaaattctttccattgctgctgtctgtctgtctgtctgtggaaaagaaatatccctttctcaagatctgtttcttcagtctgtttgtttgtttgtttgaaatgtatctgctgcaagatcaaaaagagttaacaatgaaatgaaatacacaggaagatgtcaacaatacatagtacatggcacaagtacaggtacagtacaggtacaggactcagacaagataaaaaaaggaaacaaaggaatgtatgtgatgtatgtgtatgtcgatggtatcaatcagccagacgattaatattaatacacaaggaaaaattcaccagtttgaaatcaaaattgcttgtacaaggttcaggacaccgccgtggaaaaaaaaaaccgggtatatctaaacacagccagccagccagccccaaccgccagaccgtccgttgttcaaaactccacaagaatgcagaaacacagtataaggcaaataaagaaaagaaaagaaagaaagaaagaaagaaagaaaagatcaaacgactgacgtggctaccgccaacattcgtctaagcgcccccggaccgttcggccgccacggcgcaggccaatattgccttcgcccacgagcgcgcgccatcgtctcccgacactgtcgttgtccttgccaatccggcgcgcgcactcctcccaatcgcgcttcgacagcttcagcttctctagcacaatctccaccagcttctggtcatcctcggccgtccactcggatgactcgtcctcttcgggcgtctcgatggacggaaggaccggctggtcaggttgttcgtctggttgcggggtgatttgacgggacttttgtcttgcgacggattcttccagcgactcaaagtctgcaatggccaggcccagcggcaggtcggatggcgcgcgcttctgccgcttcggggttgagaatcgatcgcgctgttctttcgcgggcatgtctacgtcgccatcgtcggcttcataggtctgacgggtcctcttgttgacgccgcgcggaggtggtgatggtttgggctgcggcttgacgaccctctgcgatcgacgtggggtcggcgcagactggatgtggaggggactctggaggcggtcggaccgtggtcgccgtggggaggagacaggcgagacgcagaggagcgactgcagggcgcgacaggtgcccagcagaccgtcaccggacgggggtggtgtaggcgagaatgcgcgagcgctagcgaaatgcgaccgggtcaggtatttgcggccctcgcaggggaccgccgacggcaagaacatggccatgatggagttggaagagcgattgaggatgtattggtggtgaagcgaccgccagcagcagcgcagcggcgacggctggagtggctggtcggatgcgccggagagcgtctcgacgggcagcgacgggatggcggtgcgaagaatcggtcaatgggttcagcgagaagacgcgcttcgatcgggatgggttctgagcgatgcgacggtgatgttggaggacaggcgaatgggagggcgatgggagagtcgcggcgatgggagaaaagtgaggacggcagccggcggggggcgggcggcgatcggtagaaatggcagatgactctggctgccccgggtgggcctgccggaaacggcgcagcctagacagtcggcgccgtttgacagtcggccgcgatagagcaccagaggaaccacttgcagagacgccctccataacggtgctgacggctgcccgatcggggcaagcaggtgtcgcagcgtccacccggcgacaccaaggagagcggagtcgtgctcgggaaattattgatagtcggtcctgtcgcaagcaaggcgccgcagggctgctttgacgagcccacgagggagagtagttgacagtaagatactctctactggcatattgctcatagatacgtgtactataccactactacactattcttctccagcgtcagagtacactgcgctgtctcgactgcttgcagcgcatctgaatctcctcggctggttgcacggtctgtgcaccatctgatgtcggcgcccgttgcgcagtcattattctgtcgtctactatcccaaaagagaagagcgcaactgggggatttccagagggggtctctgccagtctgcaaggaggctgcgatattacgccataatctctccgatcgcctggggcaacggctggccagcacctgctcctgcctgcgacctgcaagacatcaatcaattctcctactgccgcaaatcttcctatcgcagacgccaccgccgtgctgctgttcgtgcgctgataactcgactcaattcgaccactccatcatcatctcgtattccctggcaatactcctcgtaggcactgcgaagccgaacgcgggaagcgcgtcacggtcgcgcgtgagacgcgacgcgctcgcgcaacagaacagacgtgtcggccaatcagggcgcttcatttccagtatctaatataaccctttacggataactaattaactgggcgtcctccagtctgctcgtctgggaaaggcgaacagacgatcgcaagacaatcaggctcgtcagttgccctgggtacctgcgcaagaggctattgtcggtgcacgtggtgatcggaatgtagatgcacggcgactacggacagggatgactccttgcgcccgagtccccgcagacagtgacggcagacagcagccctcgagctcctaccaagggcgatctgacatcatgggagcgtcagactactactgtacaaaccatctacacaatcgcatcttcagcagagatgccagtgtgtcgagtactatagtacgaactacatctgtgtacagtacattacgtaggccaggtatctaatgcgacagaatccatccacacgtatattgaatagctgcgagtggctggtaatactgtacctacctacctaggtaggcagtccatcccttggacagggtctactctaccagacaaacctcggtacatgtcctctgtacggagtacacagtttcagtatagtcagttctcctacgctgagggagccctttctcagatcgtctccttggcacagtcggctctgatctgatctgaaggtcgtgttcgtttgtttaagctgtctggacaaccgatggatccatggatccgtgcagggtggatttacagggttcagtcggttcggcacgggccttccatctaccaaacctctcctaggtagttttttagttatcttaattaatttcactgtttcactcgactgacgcaatcagtccatcacctgactccaagggtccagttgttgattgaccgtcgagatggccaattgagtgctgtcagccccgcacccctcccttgtccctcccttcctccctgccagtctgcttgctgtgtatagtatactggtgtactaccagcctggtcgaggaatgtagactatctctgcgagtgagaagaatatagattgatgcgctgatactggttgatagctgatagctgatagcgactgagtgacagctgcatatgtatgcccactgtatgtgtatgtcggtctctgcgcataccaggtggtggctgcagtgctgctgctggtggctgaggccaaactctccgactccgagcatgtgctgcccagccacatgtggcaggtgcttgcctgccacctccaagcatttggtacctgaggcatctacatgaaatctgcctacctcactgtatcgacctggtctctttcctagaaagatactggtaaattgcaccactgtaccgtcttactggcagcatgcgacctagctcccttgtcagctaccactacgattctacctatacccatatgtactagaaagcacctatgtcgatgtcccgtactgtaccaagaacccagaccaaacccaaacacaaacaaacaaactccatcctgtctcatccctatcttaacgcaatcgcaatggccatctcatctgagatcacccactggattccctggaacatgcatgatgcaataatgcaaggggcacacaacaccataccagaaatggcattgggttttcccaatggaaacacagcactaacccgagttagtactggcttcatgcatgctgcatgcaagctgcaagctgccgagatcgatagttcaacggtttttgcttgctaggatcgattagctacctatatacccaggtatctaatggagagcgttaggcagacaaacgacatctaggtaggtactccgtactgtactgaaacaagggatgtaatcttccgagtggctggctggctggccaggcaggaagggattgaccaatcataggtagggacaaacaacacggtcgtccatctcctacatctaggatagtgtagagattctttattcgattcacatggggagtaaatatgttctctctcttgcccaggtgctcagagaagggtacttacatggactgtctgtatctatacaagtatgcgctgttatacaatctaaaatatactgtacagtgtatgcagagcgctgtagataatagatagataagctatcaacacaaaacttcttatcgacagcagtgcgtgagcatggcatgagcatgagcatgagttggacaggcgattatgcgcacgggctgtctgcacacagtgcatattttccggaggctggccagaccagcaggaagcaagcaaacaagtagccctacctacctatgtaggtatctatggtaatcaattccccgaatggctcaatcaaggagactaacgcgagtcaaggatgcttgcaagagggaggcctcctgcgatgcgatgcgatgcaaggcgagataatgcaaggcgagatccttgctttgttgccctggcctacttacttgctttttgcttgcttacttgcctatctcctaggtacacagcacgagacatacacagtacaacagatgcgacagcgctcacttcgaggtctaacttaggaggattagacgagtaatcaatcgatcaatcaatcaatcaattaattaataaacgtaaacaattgagtattaagaatttttagtcaattagagagaaaaagagaaaaagaaggaagaggaaagaaagatcgtgaaggaataaacaggaaaaaaggtggttggccagctttcttttctctcactcacaatctctctctttattttttgtcacaggtagctatttgctttcgctggtgggagatcgagagtcgagagagggctggattctctagatagatgcaagaatgaggtggatatggaatttattttatattgattgatacagaaaacgaacgcatgacagctagctggcgaggacccatggattgtctacatacctaagtatgcaagtacatagttgacttcctagtttctctataacttccatgctcgtcacattattctttctacacattacccttcttcacttccctgcaagccgagtcccgtacttgatctggtaaatctttcctgagaggggattctctacctcttcgtagacttcgccatcatcttcttccccttcctcttcttttttctcctccgcttcctctccctccacggcatagacctcctcaattggtcgtttccgcactaggacagcgagatacgagttatcgttgttcttatcattacggttgccactctgatcagcctgctgtccttgcttcgttatattccctgcattggttgcagtctccttgatcattgttcttgtttcacgatgttgtttgtaaaccgtcttctgaggacgttgccgacgaatcgcgacttgtttgccctttctgtctccgtacccggtccaggtccaggctagtgggctgaaagggaggcgtggacgaggacgaggacggcttcgtggagattgatgacgtgccggcctcgggactctgcagttgtctagatatgtagtattgccactttggcagtttttcgcatcttgccacttttcagggtctctgttctggttaattatgcagacttcgtcttcctgtgcatagaccctctcatcttcctgcatacaggaccgagcttccctcggaaagtcgggatctgacaatgtcggagatgcaagtctctgacaagtcggttcgcccgtcgaggatcttgcactcccgtccgtcgaggaagtctctaaagagggacttcttttaaggtgtgcggagtcgaaatgaatggcttgcctgtctggagacagtagatgcaaactcgaatcagatcgggtgacttgattcaacttcacagcaggctgcgccgtgaaaatctcttcaatcagaacgacgactggctcctgcacagcccgcggcttccaatcgcaaatggctcgtcggtaaacggcgtcaaattccgccttgtgcgtagggttggtgaaccatgcatgctgcaaagcggtcttcgcatccatgcgttgcgtctcgtcgaggaccagcagccgatagacaaagtccttcggacgatgtcccaccttctcccaatccggatctgcgcggagaatgtcgagatcgccctgtcgagcttgactttcggaaaaagaatatgactctgcctttcgaaacgggggagcaccgatgaggatgacgactgtcacgcagccaagggaccacatgtcgactgattttgtgtatccctgacggacggtagaagtgatttccctatgaaaacaattggccatgacgaagaaagaaagaaagtgcatgacttacggagccgtgtactccaacgtcccaagtacactcgacatccgctccaacttagactcaaccactcgagcgcagccaaagtctgtgaggacgacccggcatccatcagcaagtgatgtcatgagtatgttgtccggcttcaggtcacggtggacaatattccggacgtggaggtagtccagtgccataagaacctgtcgcacgataacggccgcttcgacgtcacggagcctgccgcctttgtactcgacgaatgagaagagatcgcctccagtgatgaggtcttgaaagatatacctgcttgtgtcagtaacctcgcgaattgagggaaacgtgactgacagtgtattctcggttttgataactctctctaagccgatgatgttgggctgttactccattgtcgatcaattattagtattgatgatgcaaatgaggatactcgaccatacatggcttagtcttttgaggatctcaacctctcgatcataaggcatgcatttcttcttgacggatttacaaggattccgaggcggaggcgacggcaactcggaaagtggtgagcgagggaagtcgatgactgtcctcctcgtaagagctcggatatccacgattttacaagccagctgctgtccgctattgacgtcgacggccatgtgcacttgtccatacgcccctgctcctagtttgcgatcggtgatggtgtactgcgattcgaaggcctatatatgacattcatcagcggaaacgggatatatcgtacaggaaccaaccttcatctcttgtctttgcagagcgctaaacgggtccgtcgtctgcccgctgcgacagcggaactggatataagagcccggagacaaccgcagaatatcgccgtcgcttagcaacacacctccattacctctggcaatcttcgctccgttccagaaggtgccgtttctggacaaatcctgagcgtacaccagaggagccacttcctgcgggttgtcgtggtcgtagatgatcgtatagatccgcacgtgcctattggaaacgaccggatcgtcgaccacgtactgactgataacgtcggtgtcagccattcagttagttattatgcagtgaggatcataccactttctctgatcacgaccgatatagacctcttcacgatagtggatatggaaagggttggtcacggcctcgctgtcgggatcccactggaacaaggtcccgacataacaatcgttggatcctaacagtggagaaggggagcgataatgttgggatgccattgtttttgtatactagatgcatcgatttcttcaaatcaaagaggaacagacctcaatgtagaggcacaatgtagagggatgaacaagcaagtcacgatcatgccatgctggtgagctgtgtgcgatatcgtgtcaattaactttgaatccctgaggatatcttatccgaatgctctcatgacagacagtgtgatggatacgtaatgcaattgatatctgaggctgagagtaacgatggggaggcgatggactggtcgtcctgggcggggtgggatccggagttcgtcctcaaaaaggatctttctcgtgacttctgccgagcagggaagaatgcggactgccgaacagagctgcctcttctcattagacattgagtcacgctatatattttgatcggagatatacagataaatgatgaatgctttagattagcgttcatcccatacgtaattgtttatcattctcgcaatatacgagggtccaaactagggacaatttttcgtgcctatctaaaacagttaaaaaaactgtagtcagaggatatggttaatgtactcgagcaaataaaatgatgtgaggaagagcaggtcgactggacatctatattgctaggtaaggagctgcaagctatttggtttcgtaacttcatactggaaaccatggttaaacttttcactaaagaaactatctttaacataagcttattaatattagctcatatttagggacttgaaatgtctgatcaaattaaatttggcttattattacatcacccccaggttcgaaatttactaaggcggtagctaaactatttttttaagagaaaaaatatttgaataaggaggttttcatagaattatatatttctggagctcgaaattaatattataagataaaatctatactcttctgatttccagaccgtgttctgttttcttctaggtgtttgcggcgataagatagtctatgcggggatttagcgtatgcaaaatttggtgcagttttggcaccccaaaacctcaaaaaattgcaacttttgtatcggaagccctccaaaccaccaaaatactgatttttctcaccaaatcccatcgattttttactgaatttgtcatatctgaggtttttctgactttctaattaggaaattatagcctatattcaaaccgatatcgagatgtctgcgaatcgcgctcctgccgccataccctacgaccttcgcaagaagcacattcctcgcatcccatccccagccccgaaccaggatcccgctggcaattatactccgatggccgctgcaaggaagataagaaaaatgaggcaaaagaaggcgtctgaagcgtctagagcgtctggagcaaggagttctgctgagagacctcaggcaaaggcgccggcgagccaaaaacgctcattgccagcaccttccaacgcgtcaaaacgtgtcagattcgagatatccaatgaagccgttactgagtcggtccctgaagctgttggtgacgcgtctgacgatgccccggtcgatactcctgccaatgctcctgacgaagtatccgatttgcaggaatccgttgataatgagtcccctcgtgagcctcctgctgaggacgaggaagaggaagctgccagagcgctttataccaccaaagaacgcttaagaagctcgtagggtatctataaggctccggggattgcttcgtttgctggagttggggtgcagaggattctggagagttggtcgcctcggatgccattttttctgcgatacgggggtaatctcgatatcggcacagacataggctataatttcctaattagaaagtcagaagaacctcagatatgacaaattcagtaaaaaatcgatgggatttggtgagaaaaatcagtattttggtggtttggagggcttccgatacaaaagttgcaattttttgaggttttggggtgccaaaactgcaccaaattttgcatacgctaaatttcctgccccgcattcctccagctccaacgaagcccctccaatcgtgttcatgcagccagtcaagccagatacagctactttattcgcttgatctgagaccatttatctgactactgtcgagcgagccctcgaatgtcgcaagagggcgtgccctccggtgagtcaatggtccattaatttatttcgggtgtataattttgccacttgtcggcagaaccatcttgcggaacactaaatataaaaacagaagaaccttttatttggaactgagtgactgttgtcctaccccgagtcaagtacttcagagtcagccttttctcgcagcatgtctcccagagtgatcgtcttcgatctcctgacagccctgctggacagctggtcgctctggaatgccgccgcaggagacgacactgctggccgtcgctggcgaactcgctatctggaaatcacctttggatcaggcgcctatcagccatatgagcgtctcgtcgagcagtcagccagcgagacgggtctttcatctgctgctgctgccaccctgctggccagctgggaccaattgcagccctggcctgaagtaccagaggtgcttgagagtttaaaggcacgaggctaccgaattgccgtcgtgaccaactgctcctcgcagctgggacaccgcgctgctgttcgctgcggagtgcccttcgatgcagtggtgacggcagaggaatctggcttctacaaaccgcatcccaaggcgtaccaggctatcctcgatgctctgggggtcaccgatccgtcagacgcactgtttgtggcaggaagcaacggagacgttacgggcgccgcagcagcaggaatgccggtagtttggcacaatcgtgtcggactccctatgctcccggggtctgctcccctcgtcgagggtcagtctttgcgccaggtccttcgagaatggctgggttacaagggcctgcagagatcggagatatccacgcctacgctgtatctcaatcgacggaaattcgccgacaactgcaagcggatgcatgacagagcggccgcgctgaacgcgaaatttcgtgtgcatatcaaaacgcacaaaacgatccaaggcacggaagaggagctgcgacatggcgatgggcgaatcgtctgtagcacgctgaaggagatcgagttcattgagccattggtcaggaaaggaaccgtgcgcagtgtaagatttagagacatctggcacagtataattgatattgaaaacctgacgtgacgctctagattctatatggtgtcccacctgcaaagtcatacatccgacggcttgcgcttctgaagaagaggctgaaggtcgagttcctcctgatgatcgaccacccgtcgcaaatctctttgctgcaggagcagagccctgatgagaagtggtctatctttatcaagatcgactgcggcacccgccgcgccggcctggagccagaatcgcagagactgaacgaattgatccagaccggactggaggcagagaatgtcaacatctacgggttttattgccattcaggccactcgtatgcaagcagcagtctgcaggaagcggagggccatctcatccacgaaatcgcttccgccgcctctgctgcgaagaaatgtctgtctcagcagccaaacttggagctcacagtgtcagtgggggcgactccgacagcgcacgctgcctccgcgtctgtctcccagcagctgaaggaccttccgggacagctggagctgcacgcggggaactatgcccttctggacctgcaacaggtcgacacgaatttggtgactctggaccaggtctccagctggatcgaggtcgaagtatgcagtgtctacctggagcgacacgagatcttggtcaatgtcggctgtctgggtctgggccgtgagccaggccgcgaaccaggcgtctggggccgtgcaaagattcttgataatcaacaggacggagaagaatacccctggaatgttgttcgcttgtcccaggagcacggcatcctggccccgcgaacctcagacccgacagcacaggaccggatgatcagcgaggtgaaggtgggttcccgagttcgcatcatcccgcagcatgcctgcatcgtcggcgccatgtacgagtcgtacattgtggtagatgacgatgacggggtgtgcgtggatgaatgggttcggtgtcgggggtggtgatgtttttgcagaagaatcagctctgcacaacatgtttatccagtctcctctcctctaatctagatagtcaaatctggaagattttgtacaaatctcatcgattcaaatctttaccatcaagtaaactgctactcattgttagcattaccaactcagcccaagaaatttcataacgacagttttgatctgggtgatatagattccatacaccaaaacttactacatatgttattgtctaccttctagatcacatcccatatccatctcatcaaattttgcaagctaatcataacaacaatgcagaatatacatatacaactgtcctctctccacaacagctctcaaatttctcgatagttcgaaaccatcacacatgaattattagctggttgacttcaacagggatactccaaaaacttttcttccaacactgggacatatacttgttttgtcttgtctaagccggagttaaagatgggtttatttggatctattcattccatggagtttttccggggtaacagggatgaacggagaataacacaactcaaagtttagtaatagttacaagtaaagtaaaagcaacgataagcaatcttaccgcagtcttgcgcaatttttttcttgccttgatccgagagtccgagtacggaggacccccaaccgggaccaaaatggatcttctacagtaccaaaggatcttcttttgggttagctcatcaaagcaaacaaacacatctctctgatcgcgaccatgaccaggcgaaccacgattcgcgacggggattattaattcttaccccgtatttttgttgacaggggtctgtacctaaagcccggtcagttgaccacagataggtcagttaggtcacgcgggaagattagaacgaacgagtgatcaggaacactaaaaaatcgcaggaatctgattagcggtctaaagttagtaactaaatcggtccgtccggcagtctgcaaatcgttgactgcggctagaactagtggatcgtgccagggaaacaaaccgccctatcagatggcgatcttgcattcctcagaatcctcatagacgccagagttacatcggcatgatgatgataacgaccagaaaagccacccagggacgaactacggtggaggattgcggggcacggattcccaacaaacaagaagaacaggtagacagatggagcgttggcatgggaactccttttttttttctctttttcttttctttttcatagaatcgttcagaaatacaggtagtgatatgagttggttgggtatgatgaactataaccatattgcctacatatgtatatgctttcagcagacatgtatatgtatgacctacatgtagagagtacggagtacttactctgcgagagatctgagctcctactaacttacggaggttacattcaacacatttcttcatcagcgcacatctacctacgggaaaatcggtttccggttttggcaatatccaccgtctatcgatccacccaagtttaactatttgacggaccacatggacggagtactccggagtataccccgcattgttctctaattgatcaatgatcatgcatgaaccactgagagtggtgacgagctggctcattggtcaactggctagctagcgtgtaagccaagctacatacatgttctccgtgcggagtctctgtatggagactatctgacgtatgcatggggctggatggctggcgctggctaaattcacgtccgatggaggccccgagtcaatcagaatgtactccgtatggagtatttagtgttaagctgtgaacctgtcgagttgctttctttctgacaggtcagggtgttggttttgacgtcttcctactgtcgacagggacagactggacgagaaatcagtgctgtttgtatatatataacatatatttgaaattcgaccaagatcatgctgttctccagactgtcactcggggccttgctgcctctcttcatcggcacgctggcgtcgcccttgcctactgctgcaagatcaggtctggtcaaaaaggagacgtccctgaatgaattcctcagcatcctcctggaccacctccctgccatcaatgaaacaatctcccaagcgtcagaggtcatcacggatctagattcggtccttgccaaactggccggcttccagacgacgtataacggcctgagcagtggttcctgcacagaatataccgtcatcttcgctcgcgggaccagcgagcctggcaacgtcggcgtcctcgtggggccgccgctcttcctggctctccaggaccggacgtccgatctcaccatccagggtgttaacgactatgccgccactgtcgaggggtaccttgagggtggtgaccccagcggaagctcagaaatgtaagcaaagattaatgaagctggttatgctggcagcatctgacggtattttcttttatagggcatcgcagatcgagtcggcgcgctcgtcctgtccgaacaccaagctgattgtaggcggctactctcagggctgtcagattgtgcataatgccgtgtccaagctgtcagccgacacggcgtcgtggatcagcaaggtcttgctgtttggagatcctggtgcgttatccctaaaactctaaactcgaagaaaggaatagtggaatactaacgcttacccgtacagacgacggacaagccctgccccacgtcgactcgtccaaggtgcacaccgtctgccacgacggggacgacatctgccagaatggcctcttcatcttgccgccgcatctgacctatgcgctggacgtcaccagcgcggctgcgtttgcgattccgtcttaatcgtaagatgcaaggaagtcacaatatatatgaagtccataagaacatcataagatgatgaagatatgaatctgtggatgatgatgatgataagctgagtgtgtgaagtcaggtgaagaagtgggcgaggtcggcagccctgagcctggccgctgcccaatcaccttccgatgcaatcaatctgcaggacagatggaaatgaggaggaacgaaatcgcgtgaaatgcgattcaatgaatgtgttcaatgtttttctgatgatatttattttgtcatattagaaatgagttggtgtaataataacggtgctcagagatgatacgaatattagacgttactccagcaggatgctcaagagaaaacggagaaataagtctaaaggtgcagtatcgcgtcttcgaaactgtagagaggcatttatgtgagcggaccaatcaccaactgtgcgagtccattgcttggcaacttcaacaacatcatctagaacactcatgtatctctagtaacgcgacattcatatatcctctttttcataaaacactattctatttctcactgtatccagtgattccgcacgaatggatggcgcggtcaacgcgtcgaatgtcgaggacaaacctcgccagaggcattcgtgctccacgtatgctcggcgaaaggtaaagtgtgatcgccaggaaccttgctcctcctgcgtcaagacaaactctgaatgtctttattctgcccaaaccacgttatcacggcgccggaaacgacatgacgctcaggaggacgtattcgcccgcctccagcggtatgaagaactcctgagaagaaacaatattgacttcacgccccgagataactggatccattttgtaatcgaagtcaataataaccagcagtcaaactcttcaacgcctagattgtctaatgagacaaaggcacacagtaggcctccaacgggtgagaactgagaagcgtgagtcacaaacagcttgttacgcccaagtacgcttggtctgacattcctataggaactggtgggcggggctgagtgatgaggtgagaattcgagcgcgagttcgagcgaagtctattcggcatctaacgatatctcacagctccgaaaccctagacaccagaaactcccaggatcactggaagaatcgtctacaatcaactctccagacgcaaatttgctgctttttggaccttcgcctcagagccttgttctggcaaatgctcatcccaaaccacaagtcatatttaagctctggcaaatttttcttgatagagtaaatcctctcaccaagatcgtccatgctccaacgctgcagcagcggattttagaggcgatggacaatgtacaggacgtccctcatggcttggaagctttgatgttctctatatacaatatcgcggtgacatccatgacgacttcggaatgcgagacggcatttggagaagagagatcgactttgctggcgagatatcgaactgcgaagctaactttacttcctctcaggacttgacagtgcaccaagcatttgttcttttactggtatgtggagctgccaaattttcccatttcttcatttacgaacgggaatgatttgggtttctgcctttaaatgtgccattctgctttccccacccccctccccctttaatgcggtagtgtggaagacgtacaaaatctatcatggactcatctgacagtgttagctttcaaatcccgactctgagtcgacttttatcctagccggggtggcagtgaggatagggcagcgacttggtcttggaaacgacaatcctggattatcctttttcgaacaagaaatgcgcatccgattatggtggcagatactctttctggatgctcgagccagccagggatgcccaggagttacaaaccgctctgcggtagcaacagagcttgcaaacatcaagctacctttgaacgttaacgattgtgacctctatccagaaatgtcagagcgacctccagaacacgcaagagcgacagagatgatttattgcctgcttaaatacgaagtcagcaccatctttcgtcactcaccacacgcggccgcactccgggctgacccgcggaaaataacaaactcgactgtgcctatgtcgaccaaagacaggttgatcgacgagctggaatttctctataatcagaagtatttgcaatattgcgatccaaaggtaccactgcaccatcttgctatcaccatggccaaattgggaatatgtgaacactataatctaattcgcaagacgaaatttgcgcagcacctgctgagtcacatgaccgccagaacgcagttggatgcgctcatctacatgctcaatgagctgcgccgacggacgacgggcgaattagtaacaaccgcatgggaacaagtcgagatggtcttcgattatcatccacgactcattaaggacaccgataacacgttatatgttgcgattggagacttgacacttaaggcttgggaagcgagagaagcggcgctctccagcgaggcagtggatctaagtcgacagtcgataccaaattacatctttgctttattgtcgagaagaaattccaatgccggtgactcatttgtcaagacggccatcgcggccgcagatagcagacaatctacggaccgccagtcacaatcagtccacgacaacgatggacaggctgcgaactttaattccaccatggacgagactacttccatgtctctggaagcgccctctgtggattggacgttctgggaagatttgcttcaagggcacgaaccggaagattttggacagccattcttcggtcaaaatggctgattatggtttcttgctggacgaccttgcattacttccgcactagtctaatcagacagaatacacgtctttcattgattttgagacggggctcgaaatcgcagcatagcagatatgtctgcgagaccttcattacgaagagcagagaacattaagcattatcaatttgatatttcacacccaaaaatccgcaatgacctgaagagagaagagtgaaaaatatcacagttggacaataatgtacatgtacagtgtacagttcaaaacaaggactcaatatcatgacgcttcagccgctgctatgattgtctccctggtgatggagctctgttcacacatactcttaaagacgtcccccagcctcgtataacgctaatggagtatcgatctccgcgacctgtccacggtcaatgacgcagatcctgtcataactgattattgtcttgagtcggtgagcgacgcacaacaaggttcgtccccggaagccttctgaaatcactttctgaatcttgcgatccgtttcaaagtcaatggagctggttgcttcgtcgcagacaattatctggctgcctcgcactaaggcgcgagcgaaagcgaggagttgtctctggccaagggagaagtttcgcccttcttcctcgactgttgtctccagattaatgtgactctgagaattctcctcttctttgctgctgttgctggcgtcaacgagctgtgattgtcgaagggcggaccagagctcgagatcggcatgagagttgaaaggatcaagattggacctgacagtgccggcgaagatcgtgggatcctgggggataatagacacccgtgaccggaggtcttgcagccctactgtcctaatatcaataccatcgacttcaattctgccttttgcaattccaccattcggaagagagccatggtaatgctggattttcctgctccagtacggccaacaatccctattctctcaccaggcttgacgtgaagattgaatccttccaatgccaaaggtaactgcggacggtacctcatgtgcacatcgtggaagacgatctcccccttctggggccagtcctccgctacagcaatagtgtgaactggagcttcctgctcaatgtcgtgtgccatagtagcaaatccgctccgtggaatgcatgctgttctcaacgtccgcagcttgcctcacggtgaactggagcatttgaacaacagttaagaggtatgacaggaccagtccactaatgctaggggaaccattaaaacgtgaggttacaactaggatctctgtcacgaagaccataatcgtcccaattgcgtcaagtcggacgctcagccagcgctggtcggcgaaggtcagaaaatatgcactgtccatatcatcgactgcgttattgatcctcctgaggaattgatcctgtaaaccatagtttcgtattgtcgagatgccaaaaatcgcttcattgaaacgtgcaaacacgacgctgcgcaagactgcttcatgcctcttgaggccccgcgcagttccgtgataataagccgccacagacaggtatattagaagcagagggcccagtgcagcggcaaaataatagtaataagcgatgatgaggataaacacggaaatgatcatggcgatcgtcatgtcagccacgcgcatcgtgtcggtcaggttgttatccatggtgtcaatatccttggaaaagcggttcatgatgcggcccagaggcgttgtgtcaaagatgggagcacgcaagactcggtgtatggctctgtgaaggagctttttgctcgcctctgtcccggccagagagagactgattgagtacaggaacagtataacggcttgggctacacccagcgcagcatagatgccgatctgtgatccgtcaatatccatcacaaaggtctgcattgacataagtactaacgtatttgccagtagaaagcctaaacttgtctgagctccaccacgccaaccacaggctggtgatgatgttgcctccctgagcaacgagcagaagtgcgagaatgagaggcaggacgagaatggagccggctgccttgaagtaatgatagtatatactccaagggacgctatcgagtcctttctcttcttcttgcatcagagagtctttcgagttctccatcatatttgaagttttttgaacagctgagtggtccgcagcggatgcttcagcattgccgtcttgctggtcacgatcgacggttgccatcatcgctctgaaccgttcattacgcgccatgagattgtcgaacgtgtcgcaagcagcgatccttccatcatccatgatgatgatcctatcacaatggtagaggacatgaagctggtgagtggcaagaatccggcacttatctttgaggagcccgcagagggcatgctccataatatggcggccaacatgagcatcaaccgcagaaaggggatcatccatgagtatgatgtcagcgtccgaatagatagctcgagcagggctcacacgctgtttctgtccaccagagaggttgatccctcgttcaccgatctctgtgaagcggccatgggcgaggatatccagatcctgacgaagggagcaggcttcgatcacttggttgaatctcgtctcgtcgagctctttcccaaaggttatgttctcctgtaccgtggcgttctgaatccaagcgttctgcgggcagtatgccttggaaccgccgacgatggcggtgccacttgtcttgcgcatgtctcccgcgagagcggctagcagagagctcttcccagagccgacccctcctacgactgctatgaattcattccgaccgatctggaggctgaaatttgtgattttaaacggccctagctcgatacgcgaaacctccgcgtctgggttagggttagttttttcttcctctttctttagggtctttcccccagacttttcggtcttcttcttcttcttcgcctctttagcttccttgtttgcatttttcttcttctttggctgttcgtctgaatcttccggagctgagtcgtcgtctgactctgccgcaaccctttcccaggtgaattccgccttatatagctccacggcatttgctgcatcaccgacttgctctatgtcattcttctggtcctccgctaggaggaactcttcaattctgtttacagccgcgagagcatcagtgaccaagccgataaccattggaaagagcatcaggggcatgcgaagctgattgaaaagggtcagtgatgagaaaatcggcgccgggtccaaagggtgacgagagagagagaaggtgatgaatgccagcattgacgcgaacaccggaacggacatgccgacggcattgactgcgtttcgtatggcaagcagaatctggatagttaggatctcttgatggcgaatcttggcgatccggtccaggaaatccatttcccaggcatagtacttgacaaatcgtatggcatgaagaacctcctgcgtcaagctgactcttttgtctgtcaggaggttgatcgttgctcgctttgcaaacatggcgcgaacggccattcccattatcggaacagagagcaggaagagtccaatccccggcaaggcgctgtaggtcaggttgaccaagaggagcgctatggtgacgaccagcgccacggaagacgtccacacaatgtggaaccagccggctgctttgtcgatgcgattggtgtctgttgacatgagactgatgattcgaccgttgctccatccctttcctccatactgtttatccatctggtctgcataccatttcttctcctcatcactgcccggtttgatatcagctgggggttcctgtggtggtctgccccctgcttttgcgcgtcctgatattgtcatggccttgttgaagatgagtgatatcaaagccgagcgaacttggccaccgaccagcatccctcggtacatgaaatggttatttccgatgcttcccaggatttgcattcccgtgattcccagcgcccatccaattcccacgccgattgccgggccttttgctccggtcttatctgcaagccaggcatcagttgcgaaagtgatcaggtatttcagaagatagggcatcaggatctgaacgagcgaggcgatcaaggagcagatgcctccgatgtaaaatatcggtcttgaaagtgtccaaaatagctcctgccagggggctttttgatttacgttcgacccgcctgtcgaaggcttcctggagacgcgcagcgataaggggggcggtgcggtttggattgacgcgccagatgtcgttcatttcagggggccgctggtatccaacctgcggacgtatcagcattaagtgcttaaatacatgtatgtactgtgcatgcattgtatgtgacagactcaccgacataagcggactcatccattcaaaagtcagaaggctgaagaaaccggctcgaaactcgggcgaaacagctcgctcggaggggacaggaggctttcgacgccgtttgagggggttcagccgcgacagccagctcgatctcgccagtaacactgggccttcctcttttgcctccatttgtatatactccgttaggagtttagtagagaggggtgtgttgctgaactaataggtctaggtctcaacgacaatgaaagcggcgcaatcagtcgctagcaagtaaggaaaaaagaaaggtgaattaaacgccgtagacaaataaaaggatgaagcttttttcttgttgaacttcctcaatccaacaaataattgacatgaaacgagcgaggagatagatactattaacgtaccacacagtacaaacgacagatcctcttcacctcttataagaatatgggggaaaatcccggctaacactttttttttgatttactttcggcccatcctatcctatcccatactatgcaatgacctgtctgtgatacccaatcgggaaatggtttgatggttcgggcccgaaggagcctgaacaggttatcctcgggcccgatgttgccttatttggaaacgccgatttaccagtagtactaggtgcctaggtacctggtattagaacaagacaaatgaattctaattctaaagactaagtaataaataacttctgactataagaggctttttttttgactaaaaaaaataagaattgatttcttgaattcattgatttgatgaaatctcgtggctttgctcgaagtcgatagataaatacatgtacagtaagtacgtcatagccgacataactactccgtatatactctctatacatgtattgaatatggatatgcagataaatagcacgtatataattacaattgcaacctctcccaatgagtttcaagtcagtccagtttttgagcaagttatatcaacatcaacaacaacaataagaagaagaagaagaagaagaaacaatctatcccagccaagatgatgataaataaaaagcaatccctcttaggaccttaaaatgaacaatcttttcgcctcacaggaaagatccgacaggcaacaaaatcagagcctcctccgcttcttgctgaaggactattactcccggtaacagctgtactgtgacttgacgtggaatgacctccatgggaggttctaatacattatatatactagtgataaatgagggctgctaagaaatgagtctaagagccttgccataaaatatgttgggaattttctgccaagaaaaaaaataaataaataggaaaagtgcgtaattgtattgattgtctatccaatatttacagataaaggaaggaaggaagagaatccattcaaaaatgattattctttccaaaaaaaaaaaggacccgcccaccagggtggggatgtgatagaagaagagaacagatcaaaaggtgattttttttctcttctctcgtcacacgtgacaagaagccaagctcatggagctcgagaatagagaatagaatgggaaggaatttctcaacggagaaacgaaaggaaaaaacaaaaagtaaagaaaggtctccgacctttgttcccacaacagcctatctgtcggacatcaaatcaaaagttcgagctagcggtcgtcgacgacccggagctgcagctgacattgttgaccacgatactcttccccgtaatgctggtgacacggacatcgaccgtgtccgttccaaacccgctgctgttctcaaagtagttgtagtacgcccgcgtggttgactgccaggtgttgccgccgtccgtgctgacctcgagcgacttgaccggcacgttggaattgacgacttgcatggcgaaccagtactgcgaggtgccgtccttgttctggaggatgatcgggctgtcgatgccgcattcgacgatcgtccagtccacgttgatgacgcccacggatgtggctgccagctcggcgaaggcgttctcgaacaggtccaggtggttctctccacatccggggcattcgtcgacgatctgttgcatgcaattagctccaaaattcatcttcatctccagtttcttttaatggacgcaccatcgccttgatcgagttaccgctaggaccagtgacagacacgcacgcaccgcagttggcggcatcatcccagttcgagtcggacagcgcagtcccaaagatgcctgcaggaagcgtgtacgaagtgaacgagcatgtcccagcggcaacgtcgcctccgtagaacgtagcctgaccagagttggtagagcccagggccactagagaggatgttaaagaggatgtcaaagagaacgcggcagaagttgactgtgcaggggcagcactgatagaagacgatgaagaagaagccacttctgacgtagaaaccacttcaacaggaacttttgaagtcgtcgcaactggagctgctgttgtcacagccgttgttgctgttgttgtgctgggttctggctgcttctgctggatgctggcggcgacagtaggcgtttcagatgacacaggggcagcagcagttgtcgaaacagcgctcgctccagcagaggtctgactggtacttgatgtttcaagggtgacctgagtcgtcgtcgtcgaagtggtcctgatagtggttgtaggttcaggcgaagaagacgacgctggtgatgacgatggcgatggagtcgcagaaacagtgacatagtacgttttcaaggcatatccaatgggacactggccatcacgacgaaagggctggttaggactggccgtggttgctgcactgagggcagcaattgcaacagctgcagcttggtagaacttcatggttcctttctctctacgcgatttgcggaaaaattgaggtcaaagatgtcgagtataatgaacaaggcagtgataataaaagaatggatgaatgataatctttttctttttcaaagatctgtgtaaggaacggcgacaaatgggaagaaatgaacgaaaggaggacgctgtctcagacagcgagcggatgggcacctgtatagggagagaaaggaggaaacgaggagagaaaaaaaaatgaagacgaggagaaaagaaagaataaaagcatcgaaagagagccatggatcttaagagctctagatcccatatagacagacagatagcattgaagctagttctcaccaacagtgggccggtgagacacggagactactctagacgacataattaattcatttcactcccattcctaaaagagtaaagtgagaatagtagagggggtcgtagatatatcgtcgtgatctggcaaattgatggcgttcaagtcgaggcactccaccagtgacctgactggaatgagctttcatatccatggactgggtactttacggagttttcactgcaaaacagagtaaatctgctacaaatctcagacacgagcttagcttagcaccatcaggcagttcccggttggtaaatacatgtgcacatccatatgaacagtagttggcatgtagtacagagtatactctcaggaccttacttaggcattggactgaaattcgaacttaccgtaaagtccagtgttgagctggggggaaataaccccaaccccattgcgtccccttcattaatatccctgaaacgccctaacccagaaaagcgtcttgaccacgcgagcggcctcctgtcaacgtcatttagcgccggaagccaacgaagcggatcggccttgacagacggccgagagatccgaataaaaggaaggcgcataatgcattttgatattattttccactattattaacacacaaaaactaactgcttttccaggaacaaagtcccttgatgcgcgtaaacatacacatacacatacacgttcccacgccaagtgctatctatctgtagtcaataatactagttgatataaagtaaaagacatgcgcatatactagatgaggactcatcccagaagtgagccaagccatgcgacatacactgagaagatttttcctcgtaaaaagacccatgacaccagccatcatgtgcctggacggacaaaaacaaacagcagggagacaaaacaagagaaaacgactctacttggaatcccacatcacctcgttcagtctcaacatcgcctcggcattgctccgcttggccgccatgtagtcctcgcggttctgctctcccttaggaccccgcatgatctccgagaaacagagatcgatcagcactttcaattcgtcataggtgaacggctccccattccctgccgcaagggccttctcaccctgcgttgcaaatgcttccttctcctccttggcatagtccagggccttctgcggaccctccaggaaccagtcgaggaacttggcactgcgaggaagggcaaccacctcgtgaaattgctcgccctcggttttctctttgtccttcttcggctccgggcttgagtcgatgatgatgttcttcagattctgctgaaggacaagcacatccagctgcagccgaagggcaccattattgttcatcgcaccaatgtaacgagtacacgagacgaaaacttggtcgatgaatcttgccaggcctgacgtaataaaccgacgctcgtttgtcccaaggtacgaggagatgttcgtatcaaaggaaatcaagtcattgttcagctcgaggatgggcggagacgccgaggtaggttgcgtaggaaggatgagatgccagttctggttgttggcactgggactcggagtcgtgggagtttcttctaccttttgagggccattcggacccgccatcgcctttgtcagcacatgaataactccgcacctaacgtcaatgtgcaatgttaggagagcggtggtagccagatttcgcagagattgaagggtgttgtcaaaaatgacgactgtctcctggttcattggcagatagaccggctggctgatgctgtcgcgttgtggtttcatagcagagatcagagtccatcgacgagtctgggtcgtccgccccgactcggaccgtgaagaatcaacagttgacgttgtgatatatctcagttttgcgagatggctcgcgagccagtgcttttgaaagagtgtgttagattgtcttttctcggacttctagttcgtcgctactcaccatgctgttgtacagtaacgacaacgccacaacagtcttgggatcggagatgatatcgtagggttccagtggcgtttcgttggtctttttgatgagaagctcggtttcctattgctactgtcagcaagactgtctcctctacaatagaatctcaggatactcactctgtcgataagctccttctttttcgcgccactcccagtccacagctctgcagccgtgtcgtggatttccccagattcagcaaacgctgctgctgccttgaatcgaaggcctccagaaggttgtgatgccactcgcgttacaagtgctgaggatgatcagcttaattgaagtgcagtgtacgaatctccatgatgctcactcacctttgtaccatccgcagcacttgtcgtagtatgtcacgatctgactgaggaccatttgagtgaacatttgatcgtgcgggatgctgtccaacatcttgctgaaggctttcaccaaggacatgaaattaacagttccctaaaggcgaaccaggttagagagcagccagagaataagattacgcagtaaaggctgctgaccttgaagatgggcttgggagacacggtggcccaattcgggtcctccgcaaaggcgtccggagcaatgaaagtcaacgtgcagagatctgtaattgcctcatccagctgcggctggaagacgttgaccaagaaatcatccaaaaaggaggtcaaggtaccgatcgcgatctcggagtcaacaggcacaaggtccttgagccgctgaatgaatgacagcgacggcgggagaaggagaccaatattgaacacgctcggttcgatcaggagcttgtggccagtgccggaattcccctgtctcgactgcgacttatcaccagtcgttgtcttctgcgacgacttggtcaccagtccaggcacagaagatctcaatatctcctccaaatcctctcgttccgccctcatctcagtcgacttcttgtcgatttcggacagcttaaacattttctgcgacgatatcagtgctcctgatccgcgttgaaggagactgccatccttacactggacttatccctctgattcaaggaataattgcgtctggcgttcgcttcgcgaggagctgatcgataagagtcatcaccgtcggtggccaaataatcatgcagaagggagcgaatctgggttcccgtttggcaattaatacatgctttgagccaaaggaaaatcaataaacgtacctcgctctggtagagcttccacaactctttaaaaccatccgccaaagtgcctctgcgcatcccctcacgctcgacaatgcctgtgatgacatcgtgaacgacacggtggccttctgcaatggcctcaaacttggcgtagagaatgtgaagaaactcagtcagcacatggccgcgctgctcgttgatctctgtcggtaggccagttttactgtcctgagacaagaggcctcgcgccaagtttggatgacgagcatcgacctctgcactggtcttgtcaaccacggaatacagctcgactggtaacctttgctctatccggtcgacggcgacatcgaggcggcccatcttatttagggcttcgatgatcactcggatatagtagaatgtgtcagcttcggggttccgagaggcgtcttccaccatgggagacgacatatctagcttcgccaggaagctgtagacaggtctgtcccaggtcgaggtgctccagctgccgcctgctcccccaccctccttttcggcggcaggggatttccatcgatcttgacaatacggagatttcaggtacaagtggtcatgcagctcttcaatcaggatgtcagtaagtgatgtctcttggttgctgaaataggcgcgcagatccacgagagctccaatgttctcaaattcggaccggcgcatcaaccggagcccctcatggaggatgtcgaccgcggcgaggaagcgcttttccgatatccgggcttctagcttttccggaagtgactggatctcctggatgtggttaaacagctgcaggacatcgtcgtattcctgagaggacattgccaagccctgcaactcgggttttgtagtgatcagaccagcctttgcctcctccagagagttcctcaacgcccgaactttgttttgtgagttgtggataccgttttggatcttgtgataagtaccaatggagctgttaaatccctggtggtgttctaatgagacagaatacgacccatcagcttgcaagtttgtttcccgattcggacacaagacccaacctaccgttgacgatcgacttcagggtcttctgtatcagcttatgcgtttccaggaactctggctcgcggtctgctttccccaatgtactgttgtccatcaactgcaacgccacctggactggtgtgcagtcgtccgctgccatgaaatcccatctacgctgaatcgtctggaggacatctgtaaaatcgcagagtcagcaaaataccgaaaaacagccattgagccataatctctgtactggcacggcaacaccataccttcaatggactgcggcccgcgcgacccatttgtatctgagcgacctctcggcttcgtatagtcgagctcatccctgtctggccgccatctggtgcctgtgtcgacgtccctgggacgcgaccgcgatgcagaggactgaggcggtcgttcccagttgggtctgtcccgcccgcgctcgcgggacgcagtcgacgacgccgttgtcgggcgctgttgcgactcttcactgtagaatcctccgtaaccacctgggcgacgctctcgctctcgtcctccgcttcctccatacccgttcacgcccaggctacctccaccgccatatgctcctcctccgtcggagcgtcccgagtcggagggatacccgtatccgtttgtataggggctgcggccgctcatgccagactccgggtctaggaatcacagaatggcagaggtagatcaagtcgccaacagaggaggcagtggtttgttctgcagaggatgggaacggcggattcgagtgtagcggcaggcggacacagacgcggtttgatgcggcggagcgatcggaggtccgattgtcaactcgctgaccatgttcccgcggggcagtttccagtgctgatgtggaaggtcttccgtcgcgtccaagccccagatctcggtgctgacttggactggggtcgattatttgagggtctgaccagactatatgattatttccaggggcgataacgaaggccatgctgccacatgcgggacggctccacacgagcttgcgggagcgcctttaccgtaccaggtaatccctggctggctggcatcgttcctcaacgcccgtttctgcagcaaaatctaggaattgggttcgaggcataaaggagtacagtatctattagacgggaaaaataatcctctatctgtaagatatgtatcatatataatgatatatacccggactcgccaaagccaaacccatgggtcctaacccccagtgaccatatagctttgttctcttattctacaggagcgaattcgtgagaagatctacctcaaagcggttgggtctcttttctcagccaattgcgggtcaattcgtcgttggcgaagaagccatgggtcttctcccacacctctgcgtggtaattattcacccattcgatctccgccgccgtcagaagcgaccgttcgatcaaattgcggcacaatgggaccatcgtgacatgctcaaagcccagccatgccttatcaccgaacttatgcggtgtctcgacttcgcgaaccataataatgtctacacaagtcagattgaagccctggtggtaagggtcagataaggtctcttactctcaatccggataccaaacttcccgtcctcatagtaccccggttctacaagagatggatcagtgacactcctctcagaaaggacttctgaactgcggcacatgacttaccatcagagatgacatttccaaccgccaggggaacctcggaatactggacacgcgtgcccaccccaatgggtccttcgtggacgttctgtcaagacgataagaaagaagaaacagaagaccaatccgcagggtgactcaccaggtgtgagccgacaccatgaccagtgccgtgaagataatccagaccgtttcgccacaagaactgccgagcaaaggcgtcaagggcgaagccgctcgtaccctttgggaagaccgccgtgtccagagcgatgactcccttgaggaccaaggtgaaggccttcttctccatttcactcggttggccaaagtgccatgtgcgggtcgtgtcggtcgtaccgtcgaggtactgtgcgcccgagtcacacaggtaaatggcgttgggatcgatgatcgagcagctgcccttctccggtttgtaatggatgacagccgcattcggccccgtcgaggagatggtgtcgaaagagagacccacgaagttctcgcgcttggagcggatctgctcgagcttctcggccgcgtccacttcgtccagcgtcgatttcttgttgatcagttcgttctccagccatgcaaggtactcggacagagcggagccatcgcgaatatgacacgcccgcatgccttcaagttcgacttcgtttttgatggccttcgcatctgcgatagggctccgcgcttcttctaccctgttctcaccacccaggctgagactcaacgcccaggatgccttgttagagatcaggtactttgcgggcgtctctccagaggcggcggcttcacccagcgcctttgcatccgcgaatatggaatcatagggcttaatgaccacatcatcacccaggtgcgccttgacctcgggggttaacttgtcttcgtcaatgtagagatccaccttgtcgggggtgatgactgcgtatgaaaagaacactggattgtagggaatgcttcatcaacaccagtcagactgtataccttaatatttctggcataatctcacgtactcgcttcctctgaggttgaagagccatgcaatctcgtcgagcatggctgtaggacgcagtcagcgcggggtcctttccaacacaatcaagcgaagattatggccgaaaaaaaaaacttacagacaatgaatccagcccgtttcttagcctgaagctccttgcggagatcagaaatcttctcctggaaggttttgccagcaaacttggtgggatggaccgtgactttctcgttgggtcgaggtgggcgctcctggccccagacgaggtcgacgaggttctgctcaatgctcaccagctttgcgccgcttttcgcaagcgtttccgagagctttttggcgctagctggaggcgtaaccgtcagccgtcgttacgcccgcgagcaaacaatagctctcgaccttaccggcggtgatgacagtcgggtcaacaccgaccacctttccaccctctgcctgctccgcagtcctaagtatagacacgccatcaatatggctctctttgcattgtgacggtccatttcttgtgggagtcgtaggttaccattcttgccaggtggggacgttctccaatcctcgcttcaagagggtccaattgctatcgagctgcttggaggcctggttgaaatatcgcccgtcggtcgagagggcggccttggtggccgacaccacggcggttcctgcggagccggtgaagccagagatgaaggctgcgaagggagagaaggtatgggttagctacggccagtgcagacagctggtcgagatctccagggccagcagctcacctcgacgtgcgtcgcacggagcaatatattcggattggtgactatcttccgagggtacgactagaggcggaggacaataatcaagcatgagcgacgaacattcaacgcgaacacggtactggaacgcgcatgcaccacctactgtaaacatcgacttgatgctcgcgcatcagctgcctgagccttgtcaggcgctcggtcgtgtccacggtgttcatctcggacgaacgacgggagaaggtatacgaaaacgctctggtcgacgagtgactaagagggtggaatgatcgcaaggacgtacgatacgcaagacggagcgggcaccgacagaagagcatggacccgaaaaagagacaaaaatggaggaggaggaaagcagagcgcagaaagaggggaaagcgcgcaggaaatggatggaggaggggaatggtggggtggtctcgtgctgctgtgctggaggaacaaactaattacggagtattcctcccagctgtacgtcagtcgcggcgttggttgcaattggcggcgccgttagggcctcgcggatttgataagctagtatattaccctgcaaataaagcagtatattaggccctctttcttttgttttcttttttttttaattttatttttcttttctttcttttttttttcgtataattacagtatttaatataagatcaaagcattcagcctagcatgtctgttcctagaactaacagcaggcaggaagtattcctccctctagttatagttggtgaggctgaaattttaggcttgttgggcgtgagaacgcctggggctgctaagcggaagcgctgccgccacgatgatgggctgccgttgttaagcccgcttactacttactgttgatgcaaaaaatactcaatgaaccaagccaaaataaaataaccaatattgctcttctaacaaagaagacgcagcagaagacatattgcaatattctcctacatctagacccaataatcacctgcataaacccctgcaaacagtgctattcagtagtgctggagggtgtgcagaaatcaacggcctcatgctgccacacgcacagcaaccaccctctcgagcatggctatatggttgctacgacgcttcttcactgtttccctcccctttcaacgccgagactgatgtgaaaatttttcactccccacagtgaagtgctgatcttctccagcaggagtcatctatccttgtcaacttcatctctccaaaatcatccttctttcatctccgttggcgcctttcctgttcccgttagcgtccttgcacgtgactgcatcctctctcccacccggccctccgtttagatctatatccaagcccctctgtccagaagcaggatggatgaggtcatgcctgctggtgctccagaccctgccgttgatataaatgctctccttgaagagacaaagaatgtcagtaatgattctgtcccagaacatctgaacttttaagaaactgtatatctgactggctctcagcttgtttccgagctttaccacccacgtggtcgcactccagctgagctcaaggccgtccaggatcgtctgcaggtcatccagaaaagtcctcaaggatggcagattgcggacggcttgttgggcgccgacgataccgacatgaggttcttcggagccttgacctttacggtcaaaattaaccaggattggtttggtccctgtccgtgaaagaagagcaatgccagaatctaacaattcggcaggaacgagctttctgagaaagacgtccaggatctcctgacctatttgatgcagcgctttgtcgccctggtcaactggggagaaaagccgttggttctcagaaagctggcgtcaagcttggtagctgttttcctcaggcctaataccacatggaaccgggccatctgtgacctggccgagtctctgagcaatcgtaatcaagttccaaaggaacagtatttgcccaccgattttgagggtgcagcactcccggctctcaacgagattcagattgctgccctgcttcttttttcgaccaccatggccgaggaagcggtcaagcggagctcccaggtccgtaggaggtcagtcatccatggacctcgattttttgcttcatttccgaactgactggcagcagtggtgagcacccggttgcggataacatcagagatgccttttgtttgtgtgattttgtcctgagacacttcctccggcagtttgttttggggaatcctgttaatgacgtgagtattggtatcgaggcactggagtcctatcgtgtatgtaatcctcttccgcgtcatgcttgcctcttaacctgtgttctaacatgattgtaggcttggctcaatgtgcgagcaaatatccggatgcgtgagccgatcgaggcatctgaattgtcctcgcaaatggagaacttggtgcagtgccttggcatccccggtctgtctaaaccagcaactgagatcctgacggaactgttgggatctggtgacaagactctgactgactggcatttgaacgtaatattggaatacatcgttagtgaggcaggatctgcacatgttactgctctcttggatggtgattacgaagacgagcatatgtctttcctggagcttgttctcacgtactcctctactcggcgggtagagcttctccttggcgcactgactcccacccacgagaagctcctcgcctacatggatactctattccatggtcctggctatccgggagccgaggataaagtcgcaccgcatctgttggaatggtggactgaggcagctgacgagctccaagagctgagcccggaggagtatgagagctccaaattggaacatgctcgacaaaatctggccaaagctgttctcaactgctttggtaggttgttgtatccgtcacgagagcagctggaccagtgggaccatgatgataagagcgagtatcattcgttcaggcgcgatgcccgcgatttcctactggctgcctatccgaccctgggcgtcgaactggtgcagctattccaacagcgcacacagtcagctttggaaactgagaactggaagaatttcgaggcttccgtcttctgccttgcccaactgtcagaagcggtagacggaaatgagcaggctgcgcagtgcttgaacgagattttcttctctgacaagtttgccgcgttgtgtgttagccaggagactcagatcacacttaaagctcgccagacccttgtcgatatgctgggaaagtatgagatcttttttgaacgcactcgagcgctgctcccgcgcgtgctgacctttttgttcgcatccctgaatgtcgcctcgtgcacggctgccgctgcacgatccatttcatcactctgcaagtcgtgccgcaccgcgctcacatctgagttgcccgtgttccttaatttgtttagagagttccatcagctacccgcggcaaccgttcagaatctagagcgagtcgtggaaggcatcgcggcggttatccaagctctcgattctgacgaggcgaaggtgccctatctgaacgacctgttgagccctttccacgcacatgcaatggctgcgcgggaagaagcacaaaaaggcgacgtcgaggctgctcgcaaccgcgggcacctggctctcagctgtatcgccagcatcggtcgaggcttgcgagccgacgtggacggcgtcgtggacctcgaaagcgacaaggattctcacgtcgccgacaacaccttctggacctctcatccctgtcagcaggggatcatccagtgtcttgagatgtttctcagcgacttccctctcgatgtgaccattgtcgagggggtgtgtgaggtcctgaaggcaggcttcactgagaaaatgggtttgtacgtctttcaccctcgcacgactgcaacctttttggccaacattcctcttgggattaacggtgcagcggacgtggtgatgagcacggcgtcagcgttcttagcttcgcacaaggctcgccctaacgagatccgcgaggaagccgggctgctcatcatccacgtttactacgcgttccgcttcatgctggagaaccctgagcagcgcgatccggagattgccaacagtggtattggcttccttacgcgtctgctcggaaagtactatcccattcttttctctttgaccaatcctccgccgcccaagacggtgcaggacaccccgacaggtccggagccgccggtcctgtccaccatcctcgactttaccctaaccgctcttcgagggcccgagcctcttcctctccgctcggcgtcgcagttctgggttggcaccctcagccttccggtgaacactgggccgattcaacgagtaattcgcgactatctcccgcggctctgccatgtcgtcattacacagcttggcgggggttgcgcgcgttccgatctgaaccatctcaccgaagtgctgaagaaaatcgtcttcaagtaccagggggcggcgcaaccgcatctggcggcggcactggaagcgctgaggaccaaagacgggaaccagcagcaacagcagcccgaagcggtgtcaaaagaacatgaccgattcctgtccatggtgctagcggcacgaggctccgcggccacgaaccagatcgtgagacagttttgggtgaagtgccgtggcgcagggtttgactatgcggggtagacagtgagcgaagtagtagtactggacgcagtcgatgggaggtgatattggttgtcaagggtggctcgtcaatggacaggacagcaaagccgtctccctcacatcaaacaaccatcacactttgctcacttttactccacctttttttttccactggtctggcactgactgactaccctttgttcttttttttccaatcaatcaatcgatcgatctatgtcttgtatgtatctccgcccgccctgtttcaagtgacgttgcatcactacgccctgggggaataaaaatcccgggaattgaagcatagcatagcatagcatagatctctctcgtcacacactttctctgtgtgtaatattgtggtgtgatgtagtgtggtattaaatacataatgattgatatccagagaagtaaattttaaaaaaaaaaaatgaaaataatgatattcttatctacatgttaagtatagatgtgtatacgtatcgtatgttggttgcttctctaaaagaaactcgatgccaaagcagatagatcgccagatatagccagatagacaggcagataggcagatgggcagaccgtcttcctttcctttctttcctttcctttcctttccaatggaactatctatgaaaaaaagtttttttcttacattaaaaatgagatgaaaatggaatgaaatgaaacggaatgaaaaatattcataagaacggtagacgtagacgtaacgcagacgtagacatagacataggaatggactcaggtgtacagtacgtatgtatctatgtgtgtctgtcttccggcttctttttcttttcttcttcctcttcttctctgctttttatgttatttttgcttgatttaccacccccgcttcgccaacttatcgccatcacccatctgcgacacattaatgccaaccatggcctcgcccagcccctcgctgacctgcgccaggacggccgggtccttgtagtgcgtgacagcctggacgatggccttggcgcgcttgcgggcatctccggacttgaagatgccggagccgacgaagacgccgtcgcagcccaactgcatcatgagcgcggcgtcggcgggcgtggcaacaccacccgcagcgaagttgacgacgggcaggcggcctttctcggccgtttcgcgcagcagctcgtacgagcagcccagctcgcgggcgtacgcgcgcagctcggtctccgggtccggcgacgagagcaggatgccccgcgcgcgcgcgatctcctcgttgacggtgcgcatgtgcttgacggcctcgacgacgtcgcccgtgccggcctcgccttttgtccggatcatggcggcgccttcggcgatgcggcgcagggcttcgcccaggttgcggcagccgcagacgaacgggaccttgaagtccgacttcttgacgtggtagcggtcgtcagccggggtgaggacttcggattcgtcgatgtagtcgactccgatggcttcgaggatctgatagccagcaagtcaatgaagattagcggataacctaataaaaagagactggcacgatctcacctggcattccacaaagtggccgatacgcgccttggccatgacgggaatggtgacggcattcatgatctctttgatcatagccgggtcggacatgcgagcaacgcctccatgggctctgatatcggcggggacacgttcgagggccatgacggcggcggcaccggcttcttctgcgattcgggcctgaaaaaatgtcagaatcagcagaattgttaattactgtctggtttttcaagcatacctgctccgcgttgacgacgtccataatcacaccgcccttcagcatctgggccagaccggccttgacggtgaagtcagaggaccggttggcgcgagtggtgccattggcgttggagccgctctgctgtgcggatgccatgatgagcgaaggcgaatgaagataacgagagaaagaagcagacggaaggaaaagaaatccacccaagaagaagaagacagagagtccgcactccgtgagtcacgatgggctgtgactgcttgagcgcttaattcgactgccgggccctctctaattctatcttagtttcccctcccccgcggcgacgagtgaaaaaaagagtccccgaggcaaagcggagacgtcaggcgtcaggccaacttaattggcatccgactccgataaccggcatgcaatatcgacctttgtgacttctctcttttttctttttttttaattcactcgcacggtatctgcaggctctaaaaaaaatagtttatatcggtccagtctcttgaccagcctgcatctgctctgcaagctctacctattatctttatctgcctatcgatgactagctagttgctgtacctgcgtcagacagtcatcgacgtccttggcacgaatagcaaccaataacgtagagaaccgttagcttctatcttcacactggcatcctaccttactgctccgccggtagccgagctgactatctacggagtatgtgtactgtacctagcgatgaggaacgtgaattgcatttatttttaaatcgtgtttttaattcctaagggagaaaaggcattaattttactgcttggcaatcgctgtctatgcaaataacgtgacaagatgcaggagctgcattgcacgtgcatacaatatcacctgactctgctgtctcgtcagcatccaaatgactaaataataatgcctgtcaggacttagtacggttggtgtataagcagagcaggaacgaggattgttgaggattgttgatgcctgaggcagaagctaccaataccaatccctgacgtcacacctcctccttggaacctcccggactcggaagtatgctctgtacagttgtacagcacaacgaacgtcctgtgcggcattgcatgtctgtcgcctgtcaagaggatactttctttattcgcctctatactctgcttccgatctatgaccaattgagcggcaatttatccatccattgctgaccaagtacatacagaataatatacaaacgaacaccgttccaatagtactgtcatacagatctaaacagaacagtacctacgacagaggaaacagacacccacatcaattatcgatatacagacagacaaaagcacacaggacgaaaaaaaaatggcaacactcctctcccgccccctcctctacacctgcgccgccgtacccctcggagtcggtctctccctcctccacccctcctcaccactctgtctaccacgcctccaatgccaatacgtcgcgcccgtgtacagtcccaaagccttcccggaaaccggctgggcgatgccggttgatcgtgaccccatcgccgtgaagcaaggccggacaacaacagcaacagcagaaaaagaaagtgacaaaagaggagcaggaggcatcctcaccgcatcgatgatgcgccagatcagtctggggagtgtcctcggattagcagtcggactgggactgcgggtgttgtccaaggcattagtgttttgctttggtgtgggtgttgttattgttgaggtatgaaataataatgatgactcctgggatcttttttttcgaaaacgtaagctaatattttattcgctttgttgtgccagtgggctgcatccaaaggatactatctcttccccgtccaccgtctgcaaaaatacgtcaagagcgtcgacctccagcgcgtcctgacggagaatatcgccttcaagacgagtttcggtacgactatggccatggcggcgtttgcgcagttttgaagtgttgagcagatcccatccaacaaatttgtgggaaaggggaaggaaggggagaagagaaacaaaagcagggattcatatgaattgataaatttctcggatttataggtttacgggttgattggttattggtatttagttggcgatattgtcgtgctcagttggcagctaccatagctggatggatggacgattgttcgttggccggagtgaacggcactcatcaatatatcgacgtttgtcttattattgtacagaatagatataataagatcccatgggtatcactgcgagttctcgtatcagctaattcagcaccaaatcttccaatacagcctccatctcctccctcgacagaggaacccccagcgtctccgtccccgtcccgtcgatccgcgacgtgatcatctggtggtcgtggaactccttgagcagagtgcggaacatcatctccgacgaggcaataaattcctccgacgccttttggtagagcgtgcggaactcgatgcagagatcgtcaccgctgccgccgctaccaccgccctcgcgacgcgaagcttcattgtcttcgtcgtcggacgccccctgtcctgactcaccagcgatcgtgagcagctccgtcagcagcaaccggtacaggttgcgcgcgttctccggcagactcttcagcacgaaggccacgccctccttgccgccgacgcgccggcccttgcggcccaacaagttgtgcacctcgtcaaccacgttccattccgcatcgtacggtgcaaacgtcgtgcagtcgtggaatacgaaattgaactggtcccgcagactgacgtcccacatgagtgtaaagttcggcgtgtccgccgtcgccagcatgttgatcgatggaatcgcggccagccgcgccagaagagcctggctggctgcccgccgtaacggaggcgcgtcgatcgagttgatgagcaccgttacgggccgctggtctgatcgagactgcagtgccgactgcaggaattcgagcacttcactgggctgggcgcccagcttcgacggcgtgtcgtcccctagaacagcactcacgatcgtagcgaagatggaccgaacagagatgccaggtgtgtaaccattcaccatgacaatgatcggagaggacgaggggggcgatcttcgatacagccaatccgcaaactgctgcaccagccggcgcttggagccgtatccatacagacagatattgaactgctcccggaactcaaagttccactgtggaaacgaccggtgatgtagttgcagcaaaatctccttttcctcttttaaagggtcctcgtaccgcgagaggcactcgaaatattcctcgtgcgtcaacaaagacaccttggacagggtattgttggatgtccgcggcggaccgggacggttctggaagaaatatcgctcgtgcggcggcagctctccctctggtgtcggcgaccgcttattcttcgctcctttggggcgtcctgcgcgacgcttgggtgtctccgctggcttcgtcgcgggtgcagcagtatctccgtccttttccacagactcaacgacgtttccgtcgtctggttcattggtactttcgtgataactctcgtcctcatcatccagaatctcctccgccagccggtctgcgccatcccatatctcatcctcgtcctgctgctcaaacaggacccgcgcgctcttcctcttggctgaccgatccgcgttcttcgcccgcgaaggtgtggctgtcgtggcaccatccttgtcgcttctcctcggcgtcgagaataacgatttggcctttgatttctgtgtaggcgtccggaggcctgacggcttcaggccattggcaggagtcgctttctttggcgtagcacgcggccgcttcgacggcgtcacagtggaagagccattcgcagcgtcgtggtcgttggcagttttctgcctcttcggggtagaggctgcaggccagtcctcatcgctgtcgatggaatctcgtgctttgcgcttcatctcagtgtgagaaaatcatgaacagtgagcaatgatcaccccaagtcgcgtaccatgctatgtaagcaatcacgacccaaaactagggtcgaattagagcaagaaggaggaatggcaatgctgcaggcatcgaccaccatccgccagtcaaaacgagcagttctggggcctgtgggcgccctttcgacctcaagcacgcgagctgcaaggagcgtcgcgtcgaccaacaaggaaagttggaagccagcttttggtttttccgactccgcgatatcaaccatctatcagctccgaaaaataagaaaaccacgccgaggcacaatctttggattgacaacaacgccaaccgctgagtggacgataaatcgctcagggctggcctacgctggtcagcgatccctgagataattaatttcccgcgaccaacaccagggtcgggtgcaattgcaattgtgagtcagcacagaggttatcgctcatacagcctgcctgacctgcttatcggtctattcctggccattgactgtgctttaattaattgccagagacagtcttccttcatattaagattttctcgtttcctgtgtttgttagagcaacaatctctgtgctgcgatcttttatcttatcagactaacgagcggagcttgtcctaagacacacactctctgttttcggccttttcctttttcttttattttctagacttgtcttcaaaatgatcattgttccaaaatctcactcccctgccatcctggcgtcctgcgcgcggattgcgaggcgccaaatccgcttctactcggtgctgcacgacagcacaatcccggagtccaagaggaagtacgtgccctcgtccggcacctatcccaagggattccgcgtttccggcacccatgtcggcgtcaaggcgtccaataccaagttccccgacctggcgctgatttcgtctgagattccatgctctgcggcggctgtgttcaccacgaacaaattccaggcggctccggtgcaggtgagcagggcgattctggacaagagacaaggccaggggatccggtcggtcgtgatcaactcgggctgcgccaatgccgtcactggcaaaggaggtctcgaggatgcctggagcatgggagccaaggtggacgactgcgatggactggatgaacccagcactctggtcatgagcaccggcgtcattgggcagcggtaggtggattttttttgccattcagaggatttttgtcttcaattgctaaatgaattgttcttattggtgtagacttcctatcaacaagattatcggcatgatcccaacggcgcactcccagctcgcctcctcgcacaacgcctggctcaccgccgcccgcgccatctgcaccacagacaccttccccaagctgctctctcggaccttcactctcccgtccgtccccggacggacctacagcctcgccggaatgaccaaaggcgcggggatgatccacccgaacatggccacgctgctgggggtcctctgcacggatgcgcccatcgacccgtcagcgatgaagccgctcctcacccatgccgtgtcgcgctcgttcaactcgatctccgtcgacggagacaccagcaccaacgacacgatcgccttcctggccaacggcgccgcgggcggcacacccattgcgtcgtcctcatcggccgactacgccgccatgcaggagatcctgacctcgttcgcgcagtcgctctcgcagctggtcgtccgcgacggcgaaggcgcgacgaaattcgtcaccgtgcgcgtgcagaactcgccctgctacgagtcggcgcgccgcatcgcctcgaccatcgcgcgctccccgctcgttaagaccgccctgtacggccgcgacgcgaactggggacggatcctgtgcgcggtcggctacacggagggcgtgacgccgggcacggtcgtccccgagcggacgagcgtgagcttccggcccgtagacggctcgccgattctgaaactgctcgtgaacggtgaaccggaggccgtggacgagacgcgcgccagcgccatcctgcagagcgaggacctcgagattgtcgtcgacctcggcggcggcgagaagggcgagagcggccgcggcggagaggaggccgtctactggttctgcgactttagccatgaatacgtcacgatcaatggtgactaccggacgtaaatttgtttgcagataagaaaagtaaagtacaaagacaacgataaaagcaaaagtttgagaacgaaaggagaaaaaaaacgaattcccgtgcatgtaacatatataaccaacccatagggtatatatattctctgtttaaaatagaatataaagaacatatatacaagtcctgatctagatcttcatcctctccgttgacacaaactatatagattagctattcttatttcttctctctcatattgttaatgatacacaaacagattggcgcttatgtacagttgcggcttgactcttattcttatttcaacaggttctcgctctttcagtcacttatacaaaagacaaaacaaaatgtctaacacttttcatccgttttagaccacaatattaaatccgagccattccatcaagccacaaccgcagcgacgcaccaatctgctatatcgaaggaagaaaaaggaaatagagaaaaatcctgatccgaccccgtgaacctcataaaataaataaggggagggaaatgtggttcccgcttagttgccaggaacaaggcctttcaggccagaaccaaagtctccttctcgggcggctatttcaaagtatccgtagatgatgctgtgaaaggtcgtcagcaagccacccttcttcgatcaaataaatggtgtagaaacttacgtcacggcaaggagaatacccgttccactacccaaggcgccaaggagatccgaggcaacagacagagcaccaatgcaagcaccaccaaaggcagccgcagtgggaatcacgcgcttgagctccctgtacatgctctgctcacggtgtccagccatcacgagaccctggtccttgagctgcttggcaacgtcacgcggggcggagccggagacctcgatccaggtcttggagaagagagcgcaagcgacaagcatgaaggtcacatacacagccgtgtgaaccgggtccagaagagcctccttgaagttcagaggaggggacatgtagtaggcaataccggacgcggcgtgcagctgagcagatccctcacgaggctcccacacacccagaagacggacgagcaggttgtccgagaagcgcgagtacagcatctggctgatcaggaagatgttggagcacagggcggactgaagcatgatgggcatgttcgaggtgtagaagaggcgaacagggtacgagccacgcacaccacgctggcgggcagacttgacggggatctcgacacggaagccctgcaggtagataacagtcgcgaagaccagaagagtagccagaaggttcatgatgttggggaggttctggcggtagaaggcctcccgcagagcacgctgcttgtcgggccaagtcagcaggaggtggaagagagcgatgatggcgccctcgaactcggggccacggccggtgttgatagtcgtgggagaaaaggccttccagacgatggactcgcagatgttggtggcgatgaagagcgaaattccgcttccaagaccatatcctttctgcagcagctcatccaggagaatgacaaccaagccggcaaccaccagctgcacgatcaggagaacacagataccagcaccgaggtcgctgggctgaccatagagaccggtaaggacgtaaacgcaagcctggccaaaggacaggataatggcgaacagcttctgagcggtctggtacagctcgcggtcggtcttgaggtcgaggttgacatcgatgaggtgggttcccgcaaggagctggctatgtcagcgaaatcaccgggctccagtttgccgaagaatacagacatacctggaacaccatgccggaggagataatgggggtgatacccaattccatcagcgtaccccggttactggccagcatcatacgcagccagtacagcggatcggaggtgtcagacgagacaatgccatacagtggcatttggctcatgaccaggaagatcaacaaggtcaactatccaccaaacacagtcagtctccaattgtctctctgttaccacctgaaggatgagatgacacatacccccgtccacatgagcttctggttgaacggcaccttggtctccggagaggccacctccggcaggaggggcgtgaagggcttgattaaatcgagaaaacgtactatagtatgtcagcaaacataaggaaacaattcaattgaatggaaccgcattgcgatacgcgattctgatcgcgtgcggcaggactccagaactcacatccactcatgatgatccccggctcaatgcgatgggagaagaaagaaaaggaaaagccggagctcaagaaccagctgaaggagcgatacaggcaaaaccagaaggaaagaagtggaaggaaagaggggaagaaagaaggaggtgaggtggccgtccggggaggaaaagtggtcgaacaggagagttggctggaagtgtgcttgctggcctgttcggccggggtgggcgctaactcgttcaggacactctggtccgatcccgcaacagctgaagggggttacggagcatcatggcaaacaccaacaaaatataatggagaaattacgccatttatggtggttctatatataggggaaccagacagatccagtgatttttttttctcaaggttatggtttaaatacctcagtagagattaaacttatccagttgcaatgtaaacaaatccgtcttccaatcactaagatggtttgaaacgacaataacagttgacaatcgtcagtatagttaatcgggaacataaagagggtattttacaaactattatcaaattgcactgtacatgagctggacctagaagaagagccataacacgaaaaaaagaaaatatacaatcaattaaagcgatatatatcatagaaacaattgatgtggaggttgaatgaaagtctaacaagtcggtagaatcaattgtccatgctatgcaaacattatcaccccgaaaatatgtaaggtaaggccagtcaatggaatttcaaaaaggcgatctctatccggcagcgacactggggttgtccgatatgccttccacataattaacaggttttgtggtcgtctgcgagtcgacatcctttttggtttcctgtggttgagatttggcgtcttcctgctcgtatgatgggggatacttctcgtccttctcgttgctcacattgtctcctcccgaaccgccaaggaccctcgaggccaaccccgaactcagcttgggcagctgctccgtatcagagccgcggaaccacttgacgagatgatatgcgctccagccccaaagccagacgcccacgccggtagatgtcgtaacgaagagcgtcggcagaagcagcagcaatgcaaacccgacgcagaaaacggtaaacagcagcgcactcagcacagccaccacgagagccgcaacgaagctgaaaacaaacacccccaccgtgagcaagacgaacaggagcagcgggattccagagaaagccacctgcgacaggagcagggttgccagcaacggatgagaagtcgcgaagagaactgaacgctgctggagggtttcgcggcgctccggaggcaagatgtgattcaggaccgcaatggctttatctgtaacagaggaaaaaccgttgaggatggtccatttgacggtggagatgggatcctcttgcgtcgcgacgacaaccatggcgtcgagggcccttgggcgtctcttcttggaaaaaaaaagaattatcaccgacgtgaggagttctgtattcagaagagaccaattggcatttggttctaagagcaaatcaggaagagggacaggaaacaaggtaggaacagtacatctatgtatcgtctcaatcagctccgctcggatttggttgctgtggggaatccaagggacacatgcacccaagcttcgatagaacccctttcccttggacgtggatcttcaagccaccacgacagtggtcacggttccggtttgcaggcagtagactgataaccgaaaataattaaaatagtagaaaacaacagttagttcagtctcatgagccactgacagggacggatgatgtggcttggatttcctctttgttgtcgctccggcgggatgacgtaaagagcaccaacatcaaccaggtgctataacgagcttaatttatttttatttaagaatttatttgattgatctacgacgtaaaacaaacggaggtgtgttatgtggcaagggaagaagtgtgtaacacacgtgtcgaataatcctgattcatccagctcatgtcgaaagtctatcctagaatgcattcataaaaatatttataccaataccatcaagtcaacgccaaacatcaattccaatgtccgagacgcattggtacccagtacccacgtagcccaaattccaacaccaaaccaatgatacgagatgctaatgcagtgtgagatcatcaatgtgtttctgcccaagaaacccatctcctcacacactcatccacaagccgtagcgcgtccttggtcgcctcgaattcgaaccattcccgatgttcttttccacactccggacacggtccctggcccttgactctgtggtctgccagctcaatatggatcagcctctccactcgatggacatggggaacccgtcttccgggttcttgggagctgtgactctcgggccttcgtgctggtgagggcgaaggtgaggaagacgaaggagagtatgggtaatagcggataagcgtcaaattatatgagcattgccttgtccattcattcatgcgacggtagacattgctcgtgcggccgatcttcaagcgaatcgtgcctggactggacccagaaccccgattgtctgcataatgactttgtacagcgcggagcgcgtcgctcgtccgacgatgatgaccaggtctattcggagagggaaggagattagaggcaatatcggatggtggaggtgcggtggagttcgaagtcgacggggtaatccaaaagatataaatgtaaccctcttcatcggcctcagagataggtttggctaattcagtgagcaagtttgctgtcgtctgaggagacagatggggcggaatccacgacaaaagtggctgagtctgggacgtggacgaggccggggtagcgggttgaaagggtcgtgtaggggtagcagagtgcccttgctttggaggtgtagttggaaccggccgttgctggataatctgagcgcgctgtggtgaatgaggtttgcggataataaccggcctttgctgcgacgcagacggtgcagttgatcctcttttatgctggtcatcaaccgggcgtgcgactggtttcgaagcagggaggtcatcggcatctgcaattcggaagcaacagaatatggtctttcctgcacggcctgcctgactggagcgaccatgtggttgcgatttcccgttcgtgccatttggaccatgtctcttagcaccatcctgacgaggctttgttctccccttttcatcattcacgtccaacacgcccaagcgttcgaccaaggtatcgatactagtcctctcttttatcggttgattatccgctcgtcctttcttttgtgtgttgccaacaaactgttccgcctggtccttgtgctgccagcaataaaaagctgctggatccgaaccaccagccatattccccttagaagacggggcaggcgatgtcagtgggcgacgacaggggcggccgttgaccgtgatccctcgacatgtcgtcgctggatttagagaatcagatcggggaagaatcgactcgggagtattggcaataaatggcataacaggagtcctcagagagtggcttcgtcccagaagagagaattgtttgcaaaaagcacaaaggagggaaactcagcggatatatatacaattggtgagtctgactctatttttggtcgttggctatgacagaatccagaaagcagtcgacaatagccggcgagattttcagaatataatagacgacctcaaaaaggactgccatatgtcagccaaaatcagggccaggcaaaattctattcagccctgcaaagcgacttccaataccgttagaagagagatgcgacatgtatgtaaatgtgtttcctacagtacgcagcacgtagtttggggttccactttccagggcacgacaagccacaatcggtccacgattcgttcctattacaggagatgaaacagagacagtcgagaccatcgcacagccgactcaggaaagagacaacagcctgggatggactgtccctttgtcttttcccgttgtgtgaggcgaagctgaaaggcgacgagctgttggctgcctgtcattggcgggtgcctgtgtaccgtgccttgcaccgccacggatcctgcaaccattggccgtgagaaatccaggtggtcgggagtggcggtgcaacagctcaacggtggctgggttctgaccaatcagatcgctccagatcgtctcgccaggtacctgtctgatggcatctgcatggctaccttatgtcctggattgtacggagaatctttgatttgattgagatttctcatataggctagtcccgtagacagtgaaatcgcaattgacttgaagaagacacatcgtagtcagtctgttgcaaatatccatccacggcgaccaaaaaaggcaaagagacaaaagaatacacaaaaaatatcatcagtcaaatcccagaatatgtctctatatatacagcagccatcttttgccatcgggaaagggcaatctgagtatgttcaacatctcagtatctcaatgcctcatcaacggaaagctccgtagtaaatgaaaagtaacgcctgtcccctcaatcccgtagtgtggactttttatatagtttggtatcgtgccttggataactatgtcctgaaatccatgtaacagaagggaataatcaaccttcaaggtgtgtctctatggttcatgagccaacgatattaaggcaatcatcgattatcgcctccaggtcaccgattcgttgtttaaggcccttgttctcttcgcccagaacgcccagtacgctccaggcctcggacgcaggcactccatgacagttggagcatttggactgcgagttgttgctgccgacgagcgcgttggtaagcggactgagacctttgatgactcggtcgtacgctgacagacgtggctggggttgcgatgcgggtgggtgtggcttaggagtcgtctgagatgttgtgctgacggggggtgacaatgtggcttcaggtgatgtagagcaagccggcgttgaaaaggtagacagcggcgatccaggatattcaatccgtcgggaaaaaatactctccgccgaactctcgtcaccagactcaaagcccgagtcactggttaaagtcgagctgctgtgtcgctttgcatgccgccggggcgtttccatgatatcgctgaagctgtcgctattccgacccgacaccagaaccacgctgcgcctgcgagcctcttcagcctcgcgtcgggcctgcctttccttctcgagctcttcggcgagagctttggtggttttctccgtctcgagggccttctgagccatgccgtcgagctgcatcttgagattttgcacccgagttcgggcttctgccagctcttcctgcaacgccgtcttctcggccatgacctcatgtaacgcgaaggttcgttgtttgtacgttgcttgcaggcgccggaggatgttctctgcattagcctgaagtgcctcaaatgcctcttggctgtactccttgctggatcccgggggaaataaggcccccgtgatatctaagttcaggaactcatcgtcggctggctcaggaagcacgggtttggccggctcttgcggtttcgaaccaaaccaagaaaaacgagacgatgcgacctgtctcagggccgacggggcggtcatccttttctggaaacggctcgtgggaggatagtttgagagcgtcgagactggcaaagtctcatgaagttgtgagttcatggtagtttctggagtggaatccatcgtcgatgggtgttctttggtgggagaaggagacctccccagggcgctagactcagattttcctggaaaccaatctgccaaggactttccaccagtgtcaaacgttcctttcgtctcagaacgagctagagatcgggcagatgaggacaaggaacgcggtggaataatctcggtgttcgcacgtcggtgattggaaggacgggtgtggtcactttctgttggttctgacagacttttagtgctatgtgttgtcaatgcagcaggaggggcgagaatcgcatcccggaaatcgtggtatgactggtaggaagccgaatcatacactgattggtttcccaggccggtgggaaagggattgcagctgctcagggagtgggtatgattgacaggtggtgtaccttgtctcaaatctcctggcattgagcaagatggagttgagcttcgaggaatgtgggagagattgccacttcctcggtgtctcagctggtcggcgccctgaaaagagacctgcaacttcacagtctccgactgtagggagtatgacagcttgctcctggccaggaatgtggaaccccagttacagctgccaagctgtgcccctgctatgcgggtctaggagagaggaggatgggaactccgagctctcagtgaagttctgaaagctctggaagcttgatgagcctgaggcaagcttccgtatccctggagaaggccccgataaaagagaatttgtcgaggacaatattgataaggggcggtggacgggggatatggtctgagcccaagcgatcgtcgtttcggctcgaacgcggattccaattccgggaacggcacaacagcgacgcacgtgccgtctcgataagagtcaacggttattgctgcaggcacgagcgagtgcgagacatggggaacgagggcatgttcttcagcacagaaggctaacgagagaccgggactcactaagagcagctcgaggaatgccgaaaatttctgccaaaaggctcgagctcgccctggggttttaatggccgtgcctacatctaccgcgtggttggggaagacgcgctgctcaaaaatgcggtggctgacgatccaccacctgcgaacgccatgctccgattcaccccgtgctatagattacagtgcagtttgcagtcttccttgaatcaataccttgtaggagaagttgagataataacaataatacggagtactctgtaatgttcaagaaggtaggactcgaggactcaggtccctgcagcaatggcagcagtgctagcgtgcagtggattaggtagctggtgtcacgacgctggtctgcgagattactcaagtacaccgtatattttgcacactctccagtctggcagtataatagtagtaagaatcttggtatcataccagacgttctactggtgtagttgtattgttctactacaacccttacatatgctgcaaggtaatgcaatatgatccgtggatggccaatagaatggctgaatctcaaccggcattcagggagctaccatggacctggatatgccatgtgcgacctatgaggtcatgtcactcacttgataaatatttttttcctgtcaattgtctcccatgcaagggggcaataaatctgtatgattgtaggacaacacccacggcccgggatttgccagtcttggcaccgcgaccacccagtcttgcagtgttaacagtacgcgtctttgccccgacagctggaaatccataccatcatggcgccagttcagggcttagagagcctctctaatgcccttgctactccatcgcagctgaccagttcctcttcctccctggacggtatcccttccgacttggaggcatctattcgctttgcaggcgccctgttgacccaagctgctggcgtgcttctgcgattgccccaagatgtgattgctcaggccattgtgatcttcactcgattttggattggtccagaaggcggaagccttgcaatctactccgctaaggtaagatttcgcaaggtagttgaaacagtggctagaggagaaaatctgatcaagacccattattcgaacaggatgtatccgcagcggctctatatctgacagcgaagctgtcgttccatcccacgtccccccgctcggttctgactgtctacacatatcttctttccaaggatgcctcgccgctgtggttcgtcaatccgaatggagtcgccaacaagcccgcgccggagacatactacctatccgaggggggctaccactccgagcgactggtgcttctgaggatggagtcggttattctccgcaccctgggcttcaatacgcacgttgccatcccccatacgattgctcttacatatctccagacaatgaatgcgacaactccggcggttgctaagcgcgtttttgagcaccttaacgcgtccctgctgtcaccacaacttctctatgtaacccatcagcccaatgccttggctgtgggtgccatctacctggccgcccgtgaggttggagtgaagttggtcgatggcgagtggtgggaagtctttgacgtggatcgcgaagagcttggcttcttagtggtcgccatgaaaagtatggctggctttgcgaaggcggagaaggaaaaatggggaggcaggcccataccattgaccgtcgacgatgtggaagcagaaattcagaaacggagatcgtcgcaggaaggagagtgaaagactacgttaagagcagcgcagatgagcgtgctactggatcgactgcatcaactcgagttcaattgagtctagcagtcgcttatctgggacgactaggaagtgcaggctcttggctgccattattcctgggcagcgcaggaagcaggtcattggaatgggcgtttggccaggatacaaatgcgatcagaccttacaccccgtgccgctgagtccgagtcgagaggctatggcatttcctcagtcgagtctcttgcacacggcagtgttctcgtcagagaaaagggaaattacgagagcacatcccgtcaacgctacaaatccgaattgggaaacaatgatcacgaccctggtggaacaaatagaggaaatttcctcgtcgggaagaacgtatgtactgtacagtacatacggtgcatacaactggacgccgtataggtgatggaagttgcaaagcatgtgaggtaaatagtttatttccacagatatattaaattgcaacctggaatgccagtcaacgtgttataatttctctactagcgtgtatgggatgggaaatctggtgatgtgatcatgtgactctgacaggtgcctgcgccacgaggcggcggcacctgatatccgcattggtcatagccgtaattaccgtaccgcgcgatactcacctccccgccgcctgattatctatcgtcctgccagtgaagtcccaaggcagaagcacatgcggtgtgaccagagatagtcaggtttccgtctcatccgctctcttctgactcttctctacgaaccaaccatcctccgtttcaagaatccgcatttgaaatctacatcaggttcatcgctgctgtctgcctctgggtattgcatcacagaaccccgcattcagagttccactccaactccgcgcgatgtcaaagaacatcatccatcagacttggtcgacctggcgggactggatcactccggtctctcacacgtcgacgtttcgtaccacaggcaagatcactccggaggagttcgtcagggccggcgattacctcgtttacaagttcccgtcctggtcctgggaagatgcctcgaccccagcgaagcgagtcccctacctgcctccgggtaagcagtacttggtgacgcggggcgtcccatgccaccgccggctgaatgacaactttgccggcgatcaggaagatgtcattgtccaggatatgcttcggggcagtggcgacgacgacgacgggtggttgcggacgggaggaggacgggagttttccgacagccaagaagccaagttgaaggacgttcggacagtcgatgaggcagggaatgttggcgagcgggaagaagaggaggacgagatcccagacatggaggacgaggatgacgaggaggcaatcatccgggaaccggccgggaagtcgggcaccacagcgtgagttgaggcttccattatctctctctcttgagtcgattgttgttgacagtcctgatggacagacctgtgcgaacatacaatctctacatcacttatgccaactactaccgcacgccacggttgtatctgtcgggctaccaggcgggggagccgcttcctccccatttgatgatggaggatattgtgggagactacaaggacaagacggtcacgttggaagatttcccgtggtttgacaccagcgtcccgatggcgaccgttcacccgtgccagcacgcctcggtcatgaagaccctcctcgaccgtgccgacgcggcgctcaagttgcgccgccagaagctcaagcaagcgcaatctctggatgaagccacgaaagtgaaggtggagagcgggctagaaggacttgtggacgataccaaggcactgtctctctccgacaagcgcggcacggccagcaccgcccctggagggggcgcaggcgacgagtgggaggtgctgcagcacgaggccaacctggaggaagacgatgagcaagagtctgcgatccgagtggaccagtacttggttgtgtttttgaagttcatcgcgagcgtaacaccgggcatagagcatgattttacgatgggcgtatagagaaatcgtttgctgacccacatactacatatatctaattctgttccttctttctcgttttctttcgttatgaatgatggatgaatggatggatggatattctacaaggttaggttttccatcttcttgtctaagagtcagtatggcagtgtacttgggtagtatgacggtaatgatggagttgttttaacgtcatggccgtggataggcagcagcagcagcacgactacctcagtttgatataatatgatattgatatgatatgatatgactgctattacttgactatgattatgatattgttcttttgcgtgttttttattctctcagtcagtgccctccttccttctttctcctctcttccaccactactttcttagagaagaaaagccatctctatctcggaagaaacaagcttaccgtcctactactactattactactgcaaacatgatagaagaactcttcgacctcctccactgctacccagcctcgcaccacctccgcgtctggaaacaagccttcacgaagcgcgccgtgaacgcatcgcagcggaactggatcagggactacgaggaggaagagcaagcggggatcgcgatcctgcagcgccgcatctttgtcgaggaggagatgcgagcggcgcagaagcaaacacagcatcagcagcggtatcaacaacatcatcatcaacaacagcaacagaaactgcaattgcagctgcagaaaacacagctgcatgaagacgacgatataatcagaagtgacgataccgatgtcgatgtcgatgacgacggtaataataatactaataatgatgttgctgttgcagtcggcgcagcaaccacctgggcgaaagaattctccgccctgaaccagaaatacttcctgcaccagcaggcgctgcacgacctactcaaggccaagccccggggcgcgcagatccgggaatgggaagtgaaccgctgccgagcgcgcaaaggctggcgctggacgcgcatgagcagcctgctgctgcgcagacaggcgcgcgaggagagcgagctgtgcgccgtccgaggcgggtgctgtggtcgcggctgtggatgttgcgagaagtcgttggccaggtatcatatctaccagagtagtggtcatcataagaaatcatcgtcgcggcggtttttcgtcttctccgtctcttcatcatcgtcatcatcttctacttcatcctccggggaaggaggagcgggaggaggaggaggtggtggtggtggtggtggaacaacgacaacgacagcgacgggtccagggacaggaacaggagccggagcaggaacaggaacaggaacagcagcaaaaaagacagggacaaaagagctctacgggcattgcacggtcgactgcccctgctgtactcgcttccggggctttcacaagcctgatgccagtgtggtcgaagcgcgcgaggaggagaggaaggcgaagaaggagcagcaggagaagaagaagcaggagaagaaaggggggatggggaatggaaatcaatcttaaagaagaaaaaaataattacgcaagaaaacgggaaaaaggaagaagacaagggaggatcgaaggtgacagtgacagtggatcacgatggcaatgatggtgaagtgactacagtacgtgattttcaattaatgattgcttcaaaggaaactaaaacaagagacacgaaagaatgaaaaagaaatagagagtgaaattttttttaaaaaaaagtcaaaaaaatcaagtaattgaattgaattgctcttcctcttgagaaaatgtaacgcaacctggaaactaagcttatatatattttactgtaggtctctatgtgagcacaaacacacacacacacacacacacagtgtataaagatgaatatatatcagtgaagatggtctttttcttcaaccgaccaatactaacactagaactattactcctagtttaacaagactatattgtattgcaaaaagacaatgacaatagatagctatctagacagagatggaagtaaatggatgaggatgtattagaatcattcattcattgaaaccttttttttttgcttgcactagaactgaatctttttacctttttgctttatgggagggaatcacctcctgactatgtcaaatgaaacatagtctatagaactggagcataaggttttcccccggaagaccgttttattgacggctttatatagaattgattgactctctataaggtacatccacacaaagtcaaactgtcacagtcaaagtaacgtcaaatctgtcaagagaaagacaagatgaagaagaagtataaagttgaaagtcgaagaagagtcaatatgtgatatgcgtcatgttggattgatgccggttgcttgtttgttcgtttgttcatccagcatagcctggctgggtcatgccttcgcgacagaagttctggctgagcatggatctagtagtagggcttcagggcttacaagccgaggccgctcaatggggaggagccgcccaagggagaaccgcccagaggagaaccacccaggggactggacgaggtcgagccgttgccttcaggagtggaaggggccgtgtcactaccggaaccctgcgcctgtctgcgagagagctgcgggctgggcgaagcgctgccagtgctgccctggccctcgcccagcgggttcactccgccgagtccgtccagggtgcccgagagactaccactagcatcgagggattgacggcggttttttcctttgtcgccaacaaccacaggaactccaggaacgttgatttcgggcgagtcgatgtcctcaggatcctccgcctgtctgcgagagaactgcgggctgtgcgaagcgctgccagcgctgccctggccctggcccagcgggttcactccgccaagttcgcccagggcgcctgtgacactaccaagagcatcgaggggcaattgacgacgggattttcctttgtcgctgcccgtcggagcaactgcccccgtgtcgccaagaaccgtagggactccaggaacgttggtgagttggggcgtgccgccgttcgcggccgctacgtcgttggcctgcaagcagaatagagtcagtcacgtcgtaacagaagatgccatggtctgatgtaaacgtaccctcgacaccgcgtcgtttaccgccttgtcgacattcgccagcacgccgtttctgccatcctgctgctggggcataggagcagccagaacggtcagcgggccgctggcgagaaggagcgcaagagccacgttgaaccgcattttggtttataaacagatgatgcaaaattatagatcaagaaagtgaaaacgttatggtcagacagaaacgtaaatccaaaagaaggacgagaagttggctgaagcgtgactgagactcgtcaagtcaattgtctggttgatgatgatgataatgagaaaagcccctctgaacgagtaactcttggtccttttatgttgttgctctcgctgaaggaaaaggggcatctcagctgtcaagcagactgtcggatgacaacaagatccatcatctgtatgatccgccgtagctgtggttgggatgcaaggcagagacgcacaagagacgatcatgatttcaagatgcacccaagcggagtgtatctgttgcggaataggtgaagacgatcgacgatcgccatcgtctccgccatttcatggatcaggacggtagacactgaagcggaaactccagatggcgtgaggtatcagatggagaagaaacaagccgccaatttcgattccgtcattttcaatagctctgtcgatcggcttcgccgttcagcaggctgcggattgacgtttggagatgcgggatctaatgcaagggatgagcctcatcacgcaggggacaaaacgagcaaccttaaaatcgatagtcatcagtcgcggctcaccatgatgatgcagaaacaatttgaaacagtgaaatctcctgctgcagtctgcaaagtcgaaacaagccagcatgcgcggatatcgtacaagcaaccaccctttttccattgtatacatgatacaaaacactagcatagaggcatcaggaacctgatctcatccgaagatcatattctcagatagatagatttctacatgacatttcatacagctgcagtgagacgagtcatgtgtagtactaaaaaagcaaaaaaaaaattctgccttcaccctagatactcagacatgtaaggaaacatgtaatcgtcaactgcaagcaaactagactttgccgcattctggcacaccaaaagcggtgccaaagttggtcgaatccttgagcttcagctccgggtccggctcgtgctgatcatcatcatcgctatcatcttgctcgtctgacggtcctgagacagccttcttcgcctcgtcaagcagtttctggtccagctcggaaagaaagctcttgtccgcctcggcatcgttctgcaacgacaagggccccttcaaggccgggtcgtccggcaggtcgagcggaaagtaggaatccgagctctccacaggctgcagcggctgcttggtcgtcgtcggtgtgagaggattctcctcctccgccatgtcatctgtcggggactgatagctagcttcggcttcagtgcccagaatagccatgggcgtgtgtcctgcatcccgcgtaaggttctcatccggcgcccccagatcggagagcttcagcttcagcggtgttctcccttccgacatgcgtctctgaggctcctggtcggacttgggcgcagatgtggactgcggtgtgacggctttggctgctacattggggggtagcgccgtcgatttgagcgtgatgccgtctagctcactgtcgaccttctcgatagggaccggcacgctggtctctgtcgaccggtcgacggctcgtgattgcggggagagcgcagcatctagcgaaggcgggtgcccgaagctgttctcatcagggaacacgcgtgtcggccgcatcgaacctgggctggacccttcccatacgtgatggccgttttggccgctattgttgctcccgccattttgttgcgagggatcatgactgtgaggccttccttggaacgaaaagtccgtccggaactgagccgtcttcgaagaggtgccattcaagccgtcggagccatccatccttgcagcttccagctcggcgattctggacttcaacagcgctctctccatgtcccatagtttgcgttcctctgcaaaggcggcccgttcgcgttcgaaattggcccgctggcgttccaacagcgcgcgcgactgttcgatatatgcggcgaattcggcatacgtcgtgccctcaggcgttctggtggctgcatgtgcagcactatagctgggatcacgcaatggattgctggtagcgaccgattgagcgcgacggacgggagtctcgacctgcgaaaatcgcacctctttataaggcgtttgtttacttggtgattttgacgaggaaggagaagaggatcgcttcattgtggaggtctctgatagaaatgattgctgcaccgtgtgaagaatgaggatggttgtttcctgcctgcgggataaggaaggaaggcatacagtcgcgctggattggcagcttctttggttttctttgtttgttcagtgcttgcgtccacaaccgatggcagtggttatctgctcacttactcgtacactggagagctctagctcggtgaatattcaatccttcgtgctagcagcgatcgccccgctctaatcctgtggccggtgacgggacaggaaccacgtacgacccgagctcgtgccgcgctctgcagtacgcagcttgcagcaacaaagacagcttcaccaaggctggctggagacaggggttgatcgaaatcgaacacagtcggttggaaggtctcaatgccaggcgatcaccgcagggcggcgcattggacctcgagaacgagctgccacgcgtaggctcagcagtggaaggggaaaaagcagacagagggcgagcgaacgagagggatcaggcgtttaaatgaattacccaaagcttcgacgcgcagttggggagttctccacgcggggaagcttgccaatagtaagcggttcaggcggggaactccaggaacggatcgtcataggccagccagctagcagaagatacaggtcagatgggagacgggaaggactgggaagaaagaatgacaggaagaaaaagagacaatttaatggagaggatagaacaaagagacagcgagtcaggcgatcacgaggtgcacaaagcggtcagttggagaggatcctttgacgcatgacgtagttcaggagctaagacggacactcggaacctcacaatacgcttccatagtattcttccaacattaagactactagctatttattgatgtctatggtcattaatatccaaagccatataaaaaatatatcaatgccccccgattgatcctttgcgccatgcctgctgatgagtagtgagttccaaccataaaaaagagcaccaaatatcccaattaacccgtctctgaatccacagacatgcaccaccaaaccaaacgccagtgttcgttgcgacccatatcccattgccccagttgtcccgctcatgctaatgtgattgaaccatttgttgttacggaataggatcgagaaaagaaaggtgaggtggcagtccaatatgtcactggttgtctccaacctcgacagagtgaacaacgctacagcgacggccgatcctgagaacgactcccccgtcgcacttgtcgttctgcctcttcgatgacgtgccggtggatgggctgcaccggatagaaggtgacctctttgcccagcgccccgaagatggtcgccagatagaagaccccccgcgcagcgagctccttgccgccgacctggggcgtggggaaatagaaccgcgggtccagatagaagatgacggatttccagcggggcaggcgctcctgcatcatcttgcccacctgcccgtacagcttcagggtccgcttgggcacgcccgtctggttatgcacgaagaagaagatctcgaagccgacgttgcggatgcggctgcgcgccgtggcgctcagcgtgtcgaggaagtcgccggcgcgctcgaggttgaacgagttgcggaagaagaaggtgtagtgcgagtacaggaagtcttcggcctcgtcgtggatctggcgattgacggacagcagcttgcgcgaccgaccatccccgcccccctgccaggtaggattcatgctcaaggcacggtatcgaccgcgcgcagtgaagctgctgccgcggtcgtcgagcacgatcaagggacggtcgagatagtcattgggggtatcgagcacgtattcgtagatcttgagacgcagttcgggagggagccgtaggagacccggtggtttgtcgccgctgttgctgttggagtagctgggcttgaggcttggttgggaatccagcgtctgcagcatgttgattgcgagaagagagggcaggagaggagcttattcaagaagcgacaacaagcgaacaccaaggtaaaacaagaagacgagaaagcagcagtggcgatggattaaccgattgacgaataattaatgaatccgacttttcctggcctttttgccttatatatatatatagaaagaaccctgcctgaaataaaccccaacccccaaaagagaaaagcaaaacagaaagggcttggaattccaattaaaacatgactccgcgggatctcctgacacagctgtcaatccgaacaaataaataactcagggtatcaatgaattaggtatcttcttttgacgtgatgggccagcccatcgtgtcaaacaggtaacggagaaaaaaaaggcaacagatttagtcttggggccgttgaactttacgatagcatcgagtcatacgtgtaaaggcccgaaccgacccaagcctcggacaatgccggcaccctcgggatgcccgttcggattcggcttgctcagtggcctgacgcgatcggtccgagtggatgccgatgcagcgggtggcctatcgttgcagatggctgatttatgcatattcatgcgtttttaactctcatcgatagagataaaagatgtagatacttacatcctgcaaaacatcgatattgtactgctttgtttttgtataccgattacatacttacttacatactaacaagaatccggggttaattaacttagtacaaaacatgtgctaggattcagaaaagcgctgcccctggcccctggcccccagattgcatatgcagactactacgtcgtaggatgcagaagtccccaccgactaaatgatcgcatctcgcacacctggaggtgttgactcgatattcctataaataaataaataaatatctgtattgccatagagataaatcagacaatgacgacacgctgatctgcgctgtttggacagctcactgtgcctgcaaggaccagcgaggtatgtgaatataggacagagctccccagtcgagaacgtgtgaggtggcgatgaattagccggcgggaacgaccttctgcagctaacgagatagcgcactggccagttagctggacgctcagacccggcctatgagctgcctctttgacaagctgtcatcgccggcatgtgaagacggacgctggcgctatacatggcaaaacgaccgcggttgtctgtctgtactgtacagatgcaataatgatgatttgtgatgatgctacagattgggcagcgtaatggcaacagtcccaagcccaaacgccagcagaatccatgatacagtgtactgtatatctataaattcacagttacaaaaacaagcacaggccaagtgtttatgtcctccgataaacacccaacccccacgacgctcgaaggatcgccagcccccaagccatgccgatgctgtcccagatcacgttgagtttgctgcccttaacctcgcgccaccccacggggacttccacgacggggatccccgcgaactcggctagcattagcatctccacatcgaagatccagccctcgcagtgcatgtacgggatgatgtacggcaacgacgcgcgggaaaagagcttgaacccgcattgggtgtctttgatggtggcggtttttggtggcgtcaggagccacaggatcagatggaacgagtgcatcagaaaattgcgcagtttcgaccgctgcgtgcacagatgtcagattaaaatgaatcctagaggtgaaaaatcgccggtccatacctttacaacggcctcgctgccaaccatgtgggcccgcgaaccgaccgcgacggcacgtttctccgaatcctcaaccgcctgacaggcagtgaccagcttcgccagatcatcaaacttggtcgctccgtctgcgtctgcaaagaccacgtactggccccggacatggcgcatgccgtgtgtgacagcgccgcctttacctcggttcttggtaagcgagacaacccggatactcccaggagggatatggatcccttcgcgggcctctggcgtccacggaccgcagtgacccgtgggatgcggcgaaagctggtgctctcgtgcgaacgcgaatgccgtctcctccgtcttgtccgtagacccatcagacacgatgaggatttcccagcctctgggctgcgcaaaaggggccgcgtgtccattggccttctcgttggctcttcgttttcgtacatcacctttctctgaccggccaggacggccattcttctcctcggccaatgtgccgtaggagcgttcgaggaagttgactgcctcctccagcatgcccgcgagacgctcctcttcattgtaagccggcaccacgactgacatgaacagctccggcttttccagctcaatgccagcgccattgttcagaccgcgttttctctctgattcccaggcgtcctgccaacacggtagtggctggggttcggtaacctcgccatcttcagacaatgttcggaagttcttttcttctgggaagggctttcgaggttcgggcgcaaccgcgaagaggaacacatacgcctgtacctgtattagtaactcgtgcactggcaagttgattgaaatcaacggacgcgtcgtaccagcgcaatgaacccaacgaaggttgcgacaaaggatatgagcaagatgtaaacggggacctggcgaatcagctccacgcagtgaaggcagatatcagtcaatgactctgccatggtggaatgatcgggtccggggaatgtaggtttgaggggagagcttcgacgagctcaaggacgcggagagacgcgggcgcaggcgatccatgcaagaagaaccccgcttgacttaaggacaagagctcgcgatgaacgagagcatcgcctgctgatctcgatcttgatcttgatctgtacagtgcggcggactctgtacagaccgatcagcagaacgcggagtgctgacacctgtcctctagtcggagtctatgccctggatcactagctggccgcgtgcttggcaccgactggctggttggtttagtgccgcgtgccgcagtcccgctaatgagcttaacgccccacgttatagatatcatttactactccgtacatcaagtatttaaaatcatgattgcgacagaaaagaaaacacaagtaagtaaggagaaaaaaaacttgaatggcctcttgaactacacatttcgcagatgcttttccattttaatctttgcaggtaaaaaaaacaaaaaaatatgcgcgttcttctctcaacatccaagatatctttccagtactcatttttcttctcatatatgcctatgaacaaaaagtaccagaatcagtaatatccttctatctcgcatgttgcgcaaatctcataaatctcattggcattaattaatgcgtgctggaataattcaagtatctaaggacagcaaacaacccattagacaggttgaaaggggaaagaaaaaaaaagaagaaaaagggaaaaaaaaggaaagcaaccatgcaggtataaggtataggagaaatattcactctcactctcatattcaataaattaatcaattgagcaattgacagtaaaccattaagaaaaaaggtaaaaagcagacatatcgacaaagtacaaagtactaaaacgtcgaattaaagagccaacgaccggatgattgattgattgattgctccatatcctaattaatccgattgttatcacaagaacaattcgatccagattttagatttaatttagatttagaatttaaaatttagtgtatggctaggataatatttggatatctgctgtgattttcgtacttaagaaggaaaagagagagagagagagaggaggagagagagagacagagaaggatagatagcgtaagtagtaggtagtagatcgtacgatataaaccatatcactccttgttttttcgctcgcgcagtttacggtgtagtattttttttgttctattttctgacttctaacatatctcataatttacctaacctaacctaatatcgatattttttaggtcttactattgtaccatagagagttgaaccgatataatgccataactttccattcaagtggatgagatctaggctatatagattttcgtcttagaaaaagtgtatttttcttatacatttatttgctgagagtggtacttatcttgaatcggagatggtatgatgataattgctagtgaatatgcgtctttctcccatggaagtgattaaatctcttggaaaagacgcattgaatgccgtatatactgtatatactgacataaatcttatatattcgtgtttgagattcctttccgattgtacggtacaatgctaaccgcgtatacggtacatttctcgtaaactcctcgtgtcatggtatcgttatgaatatcgagaccaaagtaggattcacggaggagaatgtaccaaccaaacccaatatagttccggtttgacatacgactaggtctatccattaatcgttgtagaaccatcccttactgggcgtactctcatcgaaaatatacccaaaccggtagacacgagagaaagacacccgggcaaaagtacgcatgcaaatgcacatggccgtcttttgctgaccttgccatttgtccacgatcttgcagaatcgtacgtcaagctgatcgtctgatgtcagctcagccagtctcagctttcgtacttatcttctgcaggtttgtcagcaggcaacccagaatattgcctctttttgtctcgaggagtgaggctgtaatatgcttctcgcccaggtcacgacatatatattctgcctggcatgcaaggaagtcttttaggaaaaagtgtccaaccaagtaaagtttgagcattgtcctttctccttgatcttatgatgcatgccctggccttaagagtgatgcaatcgggtatcgtggaagctgagtttctgcagggaactggccaaccctttgcttcgacagaaacaaatgtctggctgcatctgaacctccaataaaacgtgcaaaccagcacactcagacgtgatccattgatgggatactcagtggcaatagcttcgtcagcatttatcttgctgtaaagaaggtagcgcgaatcacaggttctggtggtttagctcccattattggatttgtccccgtaattgactggggcacgggtcttggtcactcataggcccatcataacagcccaaccagcccaagaaaatgatatttccaacattgacattttcattggccatgaacctcataagtgatcacggatgcccgatccgacgcccgagtccgctggaataagagttataacacgactggagtctctggttcgcatcacttccagtcagccagcctgaggttatcatcgaagtgcttagacgtgcctgctcaactggtgaggcggtgaaacaaaggtctgggccagcagaggccgtctggaaggggtcactggaagaaaatgatgcgtcgaagcgccttgctttgaacatgcaggggccctatagtggaacgccactgttacgaagattattctctgactgagagagaagagttgacttactcatttttagtaagccagtcaaatttccatctcgcccagtaaccctgcgggaaacccgagggtatgtgtcctgtcttttcatgcaacatgggtctgttcggattcttcaagccactgcatgctagacggtgctgggaaccgcccgcatcatttcaactgaacagtatcacaataaatagtaaaataaaccagcatgagtaactaactgtacgttttcatgatttgttgcttcatctttgcgagacagtgtctgcggggaaggtggggttatcacacaaagctccttcctaagactctccttttcaagttcttcgtactacgattggacgcagaaagagagagagagagagagaaataccacaatggcgaggacgtccaatatggagaatagacgtagtgctcttcgtcctcctcttccagtctggaccggggctaaatagataaagctgtcaatataaacgttaaaattagttagagaagctagtaatgagtttgtgtaacattgcattagacatgcagatattgtggggtaatgaaatggctatagacactgtgctggagggtgacattgacgaagtcacgtagtctgaaagttctcgtcgtcttggatgactgctgaacatgaactcgaaaagcaagagggaggataaaatagagtcgaaggaaaaacagataaggtctatcaagcaggaaaaaaaaaggaaaaagacagagagaaaacgttttcagtaatctttctcatgctcaccgagtctttcttatatctgcctcgtgtctgtctgcagcatcagcatgaggactttcatcaagtctaacagcataaccatttcttggcctggactgcaatcattaaacattactcgtctcgagcacggtatattgatcaattgtgtcatgaacggcgtgggagtctaggggctctatcgagaaactagcaaatgaatatcattgacaagacaaatgtatcgttagaacttgtcagaaatgaatttatcaaataagactgtaatgattcttgttcgccaggtagaaatgacggaataaaatcagggaattcctgagaatgtgcaaccataatcaatcatgtatattatacagatgtcaatagttttgcactttatcaaaaacaggaattccaaactcatttgattgtatgtatgtgcatcagactagaaggaatctttctgagaaatggaagcaagcaagccttctcagtatgagtgttattttactcacagaaagcgaagttatgaatcgcttaatctggtccatatccgatattcaatgaatttgtccatattctgtcgtcctgtcctagaaagatcgcgatctatatattccaaaaatggcaactctcgtatgtggcagacgcatcttgcattggttaggtacataggattataaatttataataaccatggcacgattaattattcttttaaatttcttctctttccattttgtgtcatctctcttcttctgtgttgttgccttttttttttctgacctgtgactattttccccaaccacgaaagaggtaaatctccgtttgtcattttttcaatctattgcaacaggcaagcaaggctttatcgatggtacttcgacttattattcagtttgagtcattccggaattccggatcagtaaactgcttacaagccattcagtcacctttgttgccttgagtttccaccttgctgtctcgtgttgctgcctgcaccccaatctatagaaaccctatgtcagcctccagactggcatctacctattgctaacaatcgttcttacacaccacgcccttgacaccccgaaacccgggtgaaatggtgggatacctgtcaggctggtcactcaagagagtgagatgacgaagatggatcagctgacatgcactgtcagttgattattctccgacgatattcagcctcacactagacgagtcagatggcagactctggtttggattattcttactttgctgcaattaataatattaatgtctgtggcgataccatccctagagaagctcatccactcccagctctacctacccatctactcgcctgctgcgcctgagtcagacacgccaccagactagaaacccagacatcagatgtacgcgtgcatgtggcaagagagattcttcgggacttgaggatatacgaaaggtaaccttgtttgtaaaaatacgaatgccatgccgcgaactctcacgccaagcaaatgacctcgtaaccttcatacagagcaatcacatgtaaatgcatcttcctgactgcaaaacgatagaactaactgcttctgttctccgcatgtttacctagaaaaggcatatgtagcgaactgcgatctagatattcaatgagccatttaggcaactattccttgaacatgttggacagatgacatgaacaaacaaacaactttctcagccgcaggatgtactgcatgagtcaagcaagcggtaaacagaaagagctcaacgaatatggtggtaagaagcaacaagattatataacacaacaacaggatggattgttctgactgttataaactactgtacatacatacgggacaggacatctctaagtcattaatcattggatgcctagttcgttctcctcatctctacaggttattcaagctatctaagtttgaaactagctatatatagcaatagcaaaagaggcaaattactgctatcggcaaaaaaaaattagatctaagccacacacgcaatactatcccttacttccgcttactccatatttatttattctgagtcatttctagatagattctggaaaattctgccaagccatgagatacattgatggatcgattgatagatagatccatcattttttcctcatcctcactgaatgagttggtttaaattatattaatgttggttgcttgtttgttggttcatgggccgattagattctattcgactaagacagatgcgtgcgagcaatgtacacttaccttgcatggcctggcctgtaatcttattcaatcatatcggcgctttgaaggataaataggatggtaaggcgtgactagtcatgttcccgtctatccgctgtatactactattgtgctgcacaatgtgctgtacatccaagatatatgttaattagatatatatgtgcatgtgcatggacacgtatcatgtacctattagcagatacatatccacgatcacatggttttcgaaagaggtatatactcggagagaatcggatcataagtcgttttctagaagcgaatggctgttcgccgaaagctactggaacgaaatcacaacctctgaattcaacaatacgcatgtcaataggttataactgataactcttgtacaaactgtactctctcacctgcacagaaacaacggttataagaccactgctggctgctttcatctatggtcctactccgtattacttaccatagtccgaatgtccgaatgtggaaccgctttattatgcaagctatgcattgaccaaggcattatgcagtgcgggtggcacctgctcaactcgcggattgctagttggagatcatatatgcactgtactctgtgcttattacagttattagctagtccactggacaatccaaatgtgataaatctgcaataagctcatagtggaatatatccagactgcatgaagtcatagcacagccacatctcccatttgagttaaggtggggtaataaaataacattaggcataacacgtggtctgtgtgtacactgtagcagtcgcaattgaaataaaaagcatccaatcctaaagacctggaccttgacagttcggcaaatatcttcggaatccgaacctgtttgatcttctgtttgatgtcgtgttcgctttctacacaacctaccacctacatgggtacatacctacttttttctctttctggaaacagaaccatgcaactagcctcaactggcaattcctcgacaatcttaaccacgacaagaacagaaaaatgaaggtgtgctcatcatgcagagaggaatagggtggggtgtttgactgcttgattgattggcaatttctgacactgacatgtaacaaacggggttttttgcccggtgacgcctcgcagattaactaactgaacaaggatgtgcgggtgcagtgtaggaggcagggatttaaattgctaccgaccttaccgacgggaaattttgccaataataatggatatcctaacaatgaagagggtgaaagaaaaaaggcaacgagggggaaaaaaagagagagagccttgttaaacagggagggaaaaaatgagaaaaagagaaccaggttgttgtaaggctgagtcctgcccagaatgacgataatagagtgcttgagggaatggaaatgcctggatgattgatactccgtaaactgggtatggcaagcactgaaaatatatctatgagtggacgttgttggggcagaaagaaagatttatatagatagacgcagcatgctaccgcaactttaaagagaactgcttgtccagagttatgaggctcgtggacgcaacagtccgcataataggaggcaactgactatccgaagtacagaacgttggaaaaccggagactagtcctatcttagtaaactactaaggtactaacgtaatcaaccaccgagcgacgaataccaccgagcgacgaattttcgccgcacccactataattttgaagcttttcaaccaccaatacaattaaattagactatctagtagttgaatatatagctatttattaggacaattccttatggtatgtccaatagtcccacagccactgcagcgttgtggagctcgccgttgaggcataggtgtaggctcatcaagcttctcattaagctgcgtatcaagctgctgaatgcgattttggcctcaaagtggacgtcaaggatgatggaattgacgaccataacgacgaataaacggaacaatgggattggtcaagtcaaaatacctttggaaaggacttcatgtatgtagaatttgttggccagccctggcgctgaggggggtgtgttggtgcctgacccatacggcattcaggcagctgccaggtctgaccaatcagctgtcagttaccacgtgaccgccaaaccggccacgcagatttagagccgacctcaacgccggctcctagtcagttcttctttttcttccccagagggagcaataatatattgatcttctatgcctagatagacttcatctatttccccactgagctctcggcagccttacgccgagaacattcacaataataagctatctttcataagctattgcattcatcataattggagctagaaggattttattattgtctttccttgtcttgttcaccagtattttgccggtaaatttagagcagcttgtagctctgcaaattaggtggcattagggctttgtattcatatacctttgttatggagaatgtgagactagtgcttcagctgaagcgtggaagggtgagcctatgcagcactaatcaccctagtcgtgcgacaggcgcctgtagatcaccccactcacccgcccctcaccccgatcgtgtgagctcagggcggcgttgctcccctactagtaccggaagagtagtcgaccaggtgcccgtagatttttgatagataggtcaaaatatcgttcaaaaatctgcgagcagttctctccttcctcactcggacactgctgctttaacggggtgagctgggtgatcagatcacccaaactgatttatactcactccatcctcacccatcctttcctgatgctcatgccagttgtttaacaacatccaaccaaggagtcgctatacatggaatagatagaaaaattgaaggtggcagtgggtcatcccctgcgacctccaaagagaaaaaaaacagtggtgaaagaggtgtcctgcgcgcctatttcgttctctccgttttctccagcctgcctctccactctccttttctttcccttccgcactttcttttgattctgcggatattttgctgtatttccatgcctgtctctacagattttctgttctctctctggtgcaagttattgctagaaatctgccaatatgctcaagaaaaaggtggatagacctgctcatgccaaggcaaatggctatgagaaagggacatattaagacaaggacagtgtgagagctgaaaacaagtattctgacgactcgattgaacttcagaacagagttttagtagactatagggtatatggtttgatccacttttttttatgataactgctaataatatgggtagatgggcatctaaggatagtaatgtcagtgaagaagattgtctctataaagagcaaccagcaccagatctggcatggttagctaggtcagcacgccggtgatttaactgatcatttaatggatcttgtcttgtcaaaatgtagagcaacaggcttggattgccaagcaggaggcgttgggcaagcatggggtgggctttgttaagcaggttgatgaagaagggcgtccagtgaaaagtcgaagtggaggtcttgttgctcgatttgatggatttggagagtaagtatttcatttatcctctataagatagaatataggataaagatacgatagtcatgttgcgtacgagtagatcgctatgctcattagaattttccttgtttcgcgcgataagatcgaattagatagataggttctaatcattagaattggttgctcaagctgtttttcgctcatctttctcttgataccatataaaattagtctgttctcacatcttcttgatcttttataattatcactatttcttcatgttatactagggattctagtctagtcaaaaagttagtcaaaattcggtcatcttattgtctgcgccgacagactcaagatagggttacaatagcttcctcgacagagatttcctattgtcactgccacgtctgagcgcaatgatgctctgagttaattaccctgtcaaatagttattcaagtatgctttgagagagttctgcatgcctaggcggcttctgaaaatagggcttaatttagccagctgctgccattctaagttataagcttccaggtctgttcagcgcacattcctaatccttatagatgggttttctgctgtaacgatgtttattctatataagatcttgtatgaaagctttccttcagatggtatctccacctattagaagatcaggtgacccgagaccttgctgccttccaaaagaggtaattagcttcctaactacaatcttatacctctattctcttcttaactctcctcctttcccagatctctctctatcctgcttctttattataattcctgttcctctgtcctctgggatttagactagacgtcatcaggagatagatgaagtttaatgtcttcaggcatccttaattattaccggagtactaacacagatccccttcctttcctctgccaaagtaccacttcctgttagtaaaacgagccaataaggtgttagcattgtcatgactttcccgaatgtggttattattattgtaactttgttaaaagatattataaacctagctagggttctagacccttctctagtaagaagttcattactatatagaatacctttatttatactccataggattaatgtcatccttcattttacacactaaatcgttccaactctagactctaagaagctggccatagtcaggtttgattaccaaccttattcgagttttccccttatcagccacacctgcattagcctttcgtatacataatccagatgctatattcattctatcaccacttaattagtaagcattactgcactgaaactagtaatctagcatcctcttaaatagcaaatatgaagtttgaagtggcaatacttgctgtggataatcctataatgtctaggtgaaacctcaggggtagaatgcaatggttatgcacagaatatgccttgcaatttgcttgcatcacaggagtcaagtcatagtttaatctagcttaatattgacaatgacattagcagagtgattatcaaactaaaataatgtatgcttaaagggagattctgctagttgacagttagtgctcagcatgtattgatactcggcatgtagagaggccatctctgatcgtggcgttcaaccgtcaatcaaaagttcgacatctttccgggtatacaactatgagtagacaacaaacggacccatcatccaagcgtctcatatctgatgtattcgcatatgcttcatcgcctcgtcccagattggacaatggcaatgtcgcccacttgggacctcactaagtgtccagcggagtagagggcgggcatcttggcaggactcttccagggggttttcccccattcacccgctggggttcgaaaatctttgacaccgtccctctatactttatggagaacttctctgcaggcggtgctgagatactgggttcgaaagaatacatgtacatgttactttcttcctcgatcgggctgggcagacaacctaggatggcccgcggagccattagccacagcgtctggcgatctactattgttgtcggcaggatctcgtcgatcgcaaagagaatcctacgggtaaaatataatatttagttgcaaataagtacatcattttcaccaattatttattgtccgctagcgcaccataaccgtgctgatcctttgggtccatggctattagagctagggcggccgaggacggactctttatcggccataacatgggagggtctgccaatggccaaaacttcttcttccccatgcatggttgcaaagagatccgatcagccaccatgcacagatgtaggatttggggcgaccactggagccgcttataagccaatctgggagcgcccaaaaaagattccctgaattattacggagatggtaatacaggggttttattaaaatattctaaagctcacgaaaattgcgtcgagtggaatttttatctatgtctataaggccaacgtgaacaactagtaacatggggggggggggggggttcttggttcgcgagagaggcctttttgccgttgagggggtataaagacctcatttctccgctgcactgtgctgaccggatcatctcttttgattcgccactcgctgctgattgctatgtcatgtactctatggagtgaccagtatgaacacgatcaataccgtatgggttcctattatgcgctctcctcattatataccgtggaagccattgactggcgccggtcacttgtcaccttgctagcctcgggcggcgtcgccttctcattgatatcttctgtgtctcccatgctctcatccgtctgctcagcccgctgttgaggggcttcgcgcagtttccgcatgaaatcatccgacagtgcggcaaatttgcacttcagccgaatagcgcttccatatttataaaagagaaagggaaaaggagtgcaggccagggcgaggaaagccggaattgttgaagcccagtggataccaaggttgtgatacatgtaagtggtgaaaagtggaaatgccatgccgaacagggaacgaagaacggcattggccgctaagacagaagccgcaaatatcgtgtaagagtcaaccagatagttgacaacagtcaaaaagacagtgaccaccccaaacccgaatggaaccgttgcaattatgctgacaatccagtggatggatggataatttgtccatgcaaaccaaaacaggctaactggaagtgcgaggccaccaactaagcatagagggagtcgagattctggaggagcaaacccttgatgcttctggacaacgcggatgtaacgcttgttatcccagagagcagcagcgacagcgaacatcatgcccactgtgacaccaagaaatgccagacccccaataccttgattccagcctcgtacttcttggaagacgatgggaaatgcagggaacagcatatagagggtcccatagattatagccatatatatcgatagtatgagcacaatcggctcacgaaagagaagtatccagggtcgcaatagcgccgcgccaaacatctccttcaaggagcttcttggtcgatcagcatccagcttactccgatatacttttccggtcatcttggctagtctctcggcccgtttgcgtagaagaacaggagcatacgtttcgggcagtaacgcagcaccaacgagccaaagagcgccggaaaaaatggccaggaaaccttctacccatttccagccttcattcatgccaagaaagcctccgataactaggacgaaacgatcaaccagtgcgacttgagaagggccagagactttgactcaccaggtccaagcgtaggtcccagaaaaggagcagccgcgaagagagtcatggccagccctctgtgtgagggatcgaacatatctgcaattgcacctcctgcattggtcagaggtgaagatccaaatgcaccagcaaagaatctcaggattaagagcgtctggatgttctgagaaccagcggcacctgcgttgaaggctgttaggcagccataggtgacgacgaagaggatttggcgaccgaacacctcactaagcggcgcccatatcaacggtccgatcgcgaagcctagaacgaacaaggagacgccgagtgtggccacttctgaaccgacatggaattgctccatgacctgagctgcaccaccactgtatgcagaggagacaaacgcgacagcaagggttgaaacagaaaccagagccgtcagcatccacttcttcaccggcgagaagagcattggattgcggggatcattaggaatccaggtgataacataggggtcatcacacgttcccgacccggtgtaggggaagttctgcacctcaggagtcaccacagcttggtcgatgacgagacgccagtgtggcgtcttggaaacctccagatcggaggtgctcttttgccctcccatatggcagttgatcaggtcaaagtcgatacagatcgccgagaacagaagcacaagaagagaacaggtgcccgtcgaagctaaggaggaatctggcaaggaaacaaagaaagaaaatccaagggggcgcaacaaagaattcgcaagtcgaaatgctggaggttcatatcggcacatcggatggtgaataattcggctgtgcataacttgagcaagcttcaggaaccgaattatgcagcctggctgacgtgccgagctccgtgaagaggaaaatacggacggcccgaatctggcacagctgcacaatctgttatctgttatcatcacccgccgactgcgcaggataaatcaccggccagagatcagttccctttgcactccgacctgtccctgtacaatgaccggtccaatgatattaagtttcaaagtaaattctagtaaatttacaagtctatattcctcttttatttgaggttgacactcgacagaaaaagaaaataatctcgactaataacgtatgcaagccacctctccgagtacgttatcggaacggataccttctggccgggagtatagtagtatcaccaacctctcatttgaaagtaatcttccttgtatttatagagcgttttcggactatggcacaccctcaacagtctaacatacatggtgccatccttatgtaagaaggccggtaggatcataattctatattagcccgatagccttaaccatccggtgttgccctagaagccaatccctaaggaaaaaactgccaaaaccttaaagaaccctaccatatactaggcatagagaatagggagggggattagtaatttggaactatgccatacataacccctatctccccctgtacagatgatgtatctagactacccccaatcctccactgtggtaatgccagctacgtgtttcgcggtgatgtcttgccggcgtcaataatattggattggggctgttctgaagacgcacggttggcctatttcggacttgacagccgtaatgagcttggaaaattggttgttcaaatggcggtcagtttctcattgaaacgaggactgcggatttgcccattactagaggtgaatagtagtatccaggccgctatatggacaggaaagcttgtgactgatactctagtgtacggagtaatactcttgtacaaacccactaatgcccgtcatagagcatttactttatgccttggatagttgctcaaccgaacagtttttcgccatcagagtcattcatcgacctttcgtaatcaatctgattgagcagttcaactcgaaatgactcctacaattatgcttagatctgtttttggactttggaagtccttcatatatcaacctaccgactcacctactccggcttccgcccaaccacaatcccaatcctcgcatctggcaccacgcccgccgcaaaacacccctcaatctccttcaatagctcatccgtctctctcagcgcggtctcctcgttcgctaccttcccactccgaagcaacatctgcggcacaaaagccctgaatgctcgcagcatccaccgctgcgccctctcatgcagctgcggctgcgcaagggtgctgcattcgtgtctggtgacgtccaccagcccggcttctttgcttgcctcgtagaccaccgcgggcgtgctgctgctgagtccgagcctcactccaaaatcaagtatttgttttgcgatttcagagaagcgcgggtattcgtcttttttgctttgggataaggcgtccaactcaaagtcgacccattggatgtagccgccgggttctggttttggagatgaggggtttcgttagctggtttccatcggaaagcagaagagaagaacccagtcccagacaatcaaaacagcaaagttacttgtgcagaccatttgaatggccacggagtaaacatgggccggatattcttactcagaagcgctactaagttagcgaccacagccttgtagtccgcttgtctgatagcaccggccaggaatctgacatggaccaaatcgtagcgattcatatgctcgggcggaaatggctccagcacatcctgaaccgagaaatgtatgtcaccagcattagcaggaaactgggcaggagagatatcgaagccctgataatatcgcgaacggtctgacggggcctccttcgtcaacagctcggagacatgcttgagccagattctatatacatgattagattagtgttataaaccatctgaacttcgctccaggtgaagaatgttcctattgtagccactaacaagtcaaaatgaggtccgcgacttaccctgtccctgtcgcaatatctgcaacagcaaacagacggtccttcgatattgatgcatggattggacttcctccaattacgtccacgaaaaatgtatgttgctcgtcaagcctgcagcgatagatatgtacatattccttgtcagtggtgaggctccgtagattgttcatggagtacttaaatacatatagcacataccgagcagactcatccttgtctctcttgagaagatagatctccttctcttgggtcatttttttatccgtgacttggcaagcgaaagtccctgttgaaagaaagaaatgataaagaaaaaaatagataaaaacggcagagcagtcgagtcgagctggtttatatacccgccttcaagtgcgggtttcagggttctggggccattagtaggtacgactatgaaccaccgtagtactacgtacatagaatgcataaaatacgtggtataactgtgtgtactacgtatatagtatgcataaaatacgttgtatcactgtgttctgtctgtcctacagccaatcaacgttataagtagcaaaaccgtcccaccatatccccttggcagcgacaatgcgtctaattggccgaaattctcaccgcttttcaaaaaccggcagtaaaccgacacgtcaacgcgcgccacgtcgaatttgaattccatataaaaatgcatataaaaacgccacgaattaattccatggcagaaagaacctccaaggaatccagctgggagtctaacatatattttatgtgtggatcgtgcgagaggcctttatgtcgacccgactccgactgggcttgttggagagagttccacaccatggaggacgcttgcctaatccggtaatatgaatagcctcggctctacggagtatatctactattattgtaaggaaatagttagttagttacctaggtagttaacctgttaataatctagtgggaacttccagtagcgaaagttacagctcgtgcattagtagtctctgccactatacctaattggttacgatacccgtctgacgaaagcagtaggcagtgaagccatcaatgtcatgtgggaccgctgagggaactgaagaagaccacttctactacgtacatgtggcctggcccggaagttctgtcttcacaagcaaaatggagaaagtatcacaggcaatcgttctcaaagcgtttgcattcagcagcggccatctcgactgcaagtcctttcttcagtgtgtaagcaagccctacataccgagaatttttggttctcatatttctcaggtaattgattcgattgttgagaatcgcggcaatcttcctaaggacctcgtatcaccgttgtctgcctttgcaaagaaatcgacaggtgatgctttgcgcttttgtttggaaaacctgtcattggttgatcttatgatccaagtgaaggccgtgccttcctcgtgaatacaatattgtggaatgttgcacagcgaagagagatcggtgagataggattcttggcaacaagtcatatacgctgtttgaggtctcccagacctttagacacattttcgtggataaagaaaatcatcatggtttggggtctcctatcagcgaggtaggctgggacaggccggagtatattttgaagctggacacaatccaggggaagtgttgtttgcttgctaaagccttcaaactcacctatagattatagcttcttaccaggccttcttccacctcttgactgcctggatagacaggatgtcctattcttcaaccgtagttccgtctatcatggaggccatatagggatactgtaagatgagggagatggtattgtccaccccaggtcagcgtacagaaaagagcatcgacaaaaggccacaaccaacgcaaaatagcaaaaaaaaaagaagtcggtggaatctaataagatgactataaaatgcttagtacccaaataatcataacagtggcgataaaggaggatgctctgcagactaaatacctgggagaagaactagaactttattttcatgttctgcagagacatgtagagccataattagtgggtcttaaggcagcaatagaagaggctatacaaatatctctaaactaataagagacatagaactgtcatatttgaggtgcagaaaactccaccaataggaaactgtggtatagtgaatgtgagacttgtccataccagctaaaagaccagttgaactggccttgcactaatcactctagttgcgcgactatcgcacagcgatcaccctactcacccgcccctcacccgccatcgggtgagttcagggcggcgatgctcacctactaaaacgagaagggtagtcgacagggtgctcgtagattttttgctcggtaggtacctatactaaggcacgtaataaggatttagcgcgcggtttgcccgctgtgatcagcaggaaggatataaatacatcctatgacaggtcacatgttgctaagctatagcttattcctgtttttgttgtctacagtacatgtactgtacctgccaggttgaatttcttcttcttggtagcctgctgtacatagtatgactacaagcagaagcaatctgccgccactttttatttttccagcgtcgatcgtgtagaatttctgctctgctaatacctactctctgcctttggattgggctattggaaatacccagtgtagtacagagtgactgtgaatgactaccgtaatggggattcagaattcattccagggctgcaaacctgtactacatttcgcctggtgaattaattggatggcaggatcagctgaatgcacattctgtacaaccctcaagctgagtacatattttgcgctgggactattactaggtgaatgcttgtctgcggtgtcttactccatacttccttagtgggaatgtttgctggctccccgcttgccatgatctctccactcaatccatctaaaccccagcgcatgctgtccactcgcgttgatctgctttccaggctattaatcttgcattgctctcattgcgcctcatcattggtgtttggtttggccggctggtctgtgcctgcagttccggccttttagcctgtgcgaatcagcgtgtctgccgctgcaatcgcctgcagagaggggtgtgcggagtatgcagtctgctgcagagcgtcacagtcacagcgctgtccatggccaatccttgccagtctttcactgcttgattctttgcttcctgcctgttggctgacccatcatcagctttgtctttgccagacttgattgatgtgctgtgatcagcaaccgaacgctacccgcccatcgtatctgaggcgctggctaagcgcccagagagctaagcttctggagctaagaatgcgtgctctgctgtgcatgccggattgccgacagggtcttttctttttctctgtgtggactctgtagtcctagtactagtatcctaggtggtacggtagtgtgatggcctcgcctcgatcgctgcttaccccccgccttttatcaatccgagagttcttcctgcacagctctttcgatctcgtctatactacagcagtcatctatctgggacctgtgaggacataattctcgcgagaagttgggtttgtttagattcttaatcaaatgccccgcaatctcttttcgatgtcatagccagtttcacccgggggctggttcttagttccttctgatttcctcaactgttgtcgctaagaggagccccatattctcaccatggcggctactcgcgctgtcctctgccttctcagcctcgtgccgggcatcctcagcttgagggtgaccccaggctcgccctgtaccagtgtgtgcgcgaatccgacgaataccaccaccgacgagatcgtctgtcttgattcacaatacaccagcaccaccaccggatcgcaatttcagagttgcatctcttgcgagttgcagagtgtctacggggaccagtccaccggagaaacagacgtagattggggtctatgtatgtgaaccctcgatcactccgcagggctagttgaatgctgatcgcatttctcccagacaatcttcgctatgccttttcagcctgcgtctataactttccagcagcggtgaccaatgtctcgacgccttgtctggtttcatgtaccccactgtcgcctgcgcttgagtttcagctgcaaaatccgaccccttctacaatggacaccttctgcggcgactcggcgtttgcggataacgtggtctcgacctgtgaagcgtgctacgcattgacgtctcaacaggcttttctggcgaattgtattttctctcttctacccccagcttgagtcatcggatcaaactgacttgttgtgacttggtagtcctggaagcaattcgctataactgtcacttccagacgctcattggaaccgcgttcccgatcagtccatcccggatcttcaactcgactgaacttcccaccacgacggcgtcgctgacgacttcttcggccgcagcggcacagtcacccgtccagaagttcctaacggttatcattgtgtttcccatcatcgggttcctaatcctcgttgccctcaccgccctctgctgcttctgtctgatccgtcaccgtcgcaagaaggccaaagaacgcagctattcgcaccacctccatgcgcgctggaatgacaccaccatcagcaccccgggacaggctgcttgggggaatttctctccctaccagagccctggcgctatgccccatcagatggtgggttcacctggttatggttatggatccggcttcgacgtggtcgattccgacgggcggaggtacgacgctggattctcgaagaccgggtttgcgtcgtacgcgtcaccggtatctccgggcgtccctgctccggctcaggcgtttcaccctcatgaggctgagaagcccgctgagcagcaacagacccatttccctccgcctccatcccagcagggtcgatgaccatctttcaggagataaatgtgttcggcgcggttttctgatataacgccttcttccattctttgactatcaggcgttgcttgttacgttgtccggttatgattatgtatgcaccagatttaccagccatggagtgaagcacaccctccccgcgccatggacagtgctggacgcacctggggcgcacttgacgatgttatacgagtttacggagatgggagttatataagcgtcactttttttttgttttaccttctctcttactccacttgtacagctttgatacccgagtcctgtctgttaataaataaataggcttttggtctggaactacttattatcactccttaggattgattgatctgacgtgcaatctcggaagattaacgtatatagcaggtaatgagataatattaaggaaaatattcagaaactatgcaatgatactaatgccttgccatatatttatgcaatcaacacatgtcctcgtgaatgccagattgaactggacgaagtgcgggcattccgtttcctgtcgtgtggggaacgtgctcggcaaagcttggaccccgaccagcgcccgcagctcgacgccagtcatcatccgctttcagactagcatctgccgtccgcactcacgtcgcaacctcctcagggactacctaggtacagtacagcccctcgtttgatatacacagcttggcagcttccaatggcgacctctataaatgagaaccaagtcaaggttctcgagcagacgcgacagcgtctgatgcagctcacccactcgctgggctccctcgtcgcaagcttgcagcatagcgatcctctgccctcatggtatatcttcgctcgtgttgttgttgttgttgttgttgttgttgttgttgttgttgttgttgttatgtttgactgctgatcgctaattgaacacaggagttcgctgcagtcgcaagccaacattatctcgaacaatctgaacagtatctccgcgcagctgtgggagcatcatgagcttctctcctccctcgtcgcctacccggccccctcctttccggggcgcaccgaggctggcgttctagaacaattgctgcgtacaaagctggatcctcgcgtggaagattgggttgcgcggggccggactgcaggtgcttccgcgctgggagatagagacgggctcagcgaggaggagctgaccgagctgtgggaatgggcacccattgaagcaaacatggaagcaagaaggcggaactggggtggtaatttcacgttggaggaaaagaaatgggcatccagaatgtggtcacgggtctgaagcgtcagctcgcggacgaggaatcagaagaggaagaggaggaggaggaggaagtagaagacgagatggaaatggtaggagtccaagagaaggctccaggtgctggtgtcgagtcttctgagagcgctgcggagagaggccctgccccatccaaaccggcgatacccgctctgcctctggatgaggtattccgttacatgatgactggcacacagcccaagtcagcatcctctaagtgacgagcaaaaagcacgtgctcctcagaccgtgaatatcgcaccgtgaattcacatactgccccttcaccgccttcatagaccgctgccatggagcgatataaaatctctcttgtcttgcttcatgacttgtccacaccagtctcatcccatctctgacacgtcccatctttgactggtgggctcctttttctccgttgttcctgctctgttctttgcacttgactgctctgcaagtctgagctatctcaaaggttagttgtattcctgcgtgtctttctgtttttattttggagatctgtttagggctagagcggtggctagggctgcagtcacgcctgcacctggttccgcgacattgcctactcaggataagaattttgtcagcttcatgattgcatgtttcagtttccatgtgttctttctttctttctttttttgtcgtggtagactttggctgacatggtccccagctacactacgcaacgccctcacacggacttaggatgtcaagcgagatggcagattaggatgtctagcgagatggcagataaaaaatccatccaggatattgttatacggccgccaccaaaacccgcgtgtccgagtcctttttccgtctgcacagggaaattcgtttgattatttacgagcacgtcttcacattaccaccactgagcggcgggacctatccggatttccttcccgtccggttcaatctggagcgcttccttgccctcctgttgacttgtcgcacaatttattgggaggcgcggttgattcctttcaaggctaacatcttcaacctttgccgtccattggaccctttctggagtatgcattgtagcctccaactcatccgcagcctccgccgatggcaggtcgacgccttgcagggcatggtgatacatctacagcaggacgacattgttggattctattccttcgccagaatgtccgtccacactcaccgtggtctcttggctgagaacgtcgacctcggatgcccgattgctcctcttttcgacagggtggtcaccgagctaggctccgaacccagttacctgcacatgcgggacaacaacgccgaattcaagaccatcggaccgctcaaaccgggctcgaagtggtcggagatcctgaaggactgggtcggcaaggacgttgtgctttcccgactggcccgtccgaaggcatcctgggctcttctgtgctgatcgatctcggtcgtcggctttttcttcttcgagactcgagactcgagactcgatgttctttcttttgacacgacaatacatctgcatacatggaggatgggaggtgtttttttcaaggcgtcgaatagggcatggatacatacgtgggagcatggaaggtgaggtgttcaggacatggcatggatgggaagcattttcagggagttttcgggttacagtacaacaataaggggggaatttgaaatggtcggatttgcaaaagttcctgggttattaaaaagaaaaaaagtaataactaataactaatactggcaatggcattacttccgaaaaactagtcaaatgactctctttttctttttaacccctccgtctggtagtgggtgtctttcctgtcggtctcggggcgacgctgctgctttcggccgtagcagcagcaagagcaggagcagcagcagcaggggtcttttccaccaccgtcttctggggcttcttctcggcccgggcaaggcccgggctgttccagtagtagaccatctgcagcgcgaggatggcgttgagcgagaaagcggcgacgaagctgtacaggatgagcttgtcgtcgacttcctgcagcgtcgtgaagatgcgggagagcgatccgaggaggtagttgaacacctgcagtcaagcggaagcagtcagtcagtcagcgatcaggtctttctgtctgcctgtcgagttgttgtagagtagaaattgcttacagcgaacgcgctcagctgtccggttccaccctctcgccagatggcgtaaatctgcggcaccttgctcgcgacgcccagcaggcccgcgcccgcctggaggtaggccagcgtgtgtgcatccaccaagctcgcatcgaacagcagagcgtagatgctcgccgcaacgacagcaacaaaggtcgctgccgcggcaggcttcccggcaaacgtcaagaccagcacgccgacgacgacatcctgcacggcaatcaaggctgtctcaccgtaggtgctgaacgggaactgctggcgcacgttgtaagagagagtgatgagcagactggccgtctcgagcgcgtacgagacgaacgacacgccggccgaggagcgcgagctgacgagcttgaggatctgcggcaccttgacgatggcgctggcaccgacgatggccaggcccagcgccttggagatggcgagcgacgtgcaggccgggtccttgctgacgtcgaggtcgagcaccagtgcgctgtggcacggcgatccgatcagcgagataatcgcatcgtggacgggctccggcagagcggtcgtgacgggctgcaagtacggcttgagcggatcaagcaccgtggtttggagtttgtccatttggcgtggtccaatagaagaaagttgtcagctatatcgaggatgaacgaagcccgcaagatgccttgtcgatgtttctctctgatcggtggggaatgaagtaaacaaaagcaaatcgtaactgtcgagtcggaaatccacgtggagacggactgcggttgtggtcgctgcggcttctccgacaaaattgcatccagtcttcttctccaatcagccctccgtctttccgacaacgcaccctcaatgctgattccgcgggcaaactgcggtgcagccttgtcatgatcgtacggccgtcgctgctgaggccagtgtcggctctcgactcggcgtcgctgtgctcgcgatgcctctccagactgggccggccgtctcccggctcgctgcggcggagctttgttgcctcgacgtatcgcctgtctggagctgctgacggctcagcggccatcccgaaggcctttcacagggactacttctcttcgcatgagccattggctcgtggcgctgacagaaaggggctgttggcgtcaggcgggacggcctcgatcaatacgtccgcaccctccgccaaccatgcgccgccgacggagaatcccaccgctccaattgctgcagagatatcacaggaacttcctcacccacgacggaaacgattaaagcaggtggctgctgccaatgcgacctcaggcgaacccatcattcctctcgacgcttccgctcgactctccgctatctcctcagcgcttcccaccacctccctccggcgcaaactcacggcgtattttgcccttacaaaacctcgtctctcctttcttattctcttgacgactacctctgcatatggcctctatccaatctccgcgcttctcaccctcgatccctccgtggcccaaccgaccctgtccacctctactcttacattcctctacctggccacgggaacgttcttgtcaagtgccagtgccaatacgctaaatatgttcttcgagccgaagtacgatgcacgaatgacgcggacgcgcagcaggcctctggtccgtggactggtgtcgagtcgcggagcggttctcttcgccattgcgacgggactgactggtgtcacgttgctttacgtggggacgaatcccaccgttgcagcgttatcagcggcgaatatatgcctctatgcatttgcctatacgccgctgaagagaattcatgtcattaatacttgggttggtgccatcgtgggtgccattcccccgatgatgggctgggttgctgcagcgggtcagacggcgacgacgggccatgacacctggcgggatatgctgctgagcgaagacagcatcggcggatggctgttggctgcattgctctttgcgtggcagttcccgcatttcaactcgctctcccacctcatccgggaggaatacaaggccgcgggccaccagatgatggcgtgggtgaacccggctcgcaatgcgcgcgtcgcgctccgatattcgattctcatgttccccatcgcctgtgggatgtggtggactggcattgtcaacaattggttcttggtcagcagcacgctggccaacgggtggctggtcaaggaggcatatcaattctggaagcaccagggtgcgaaagggagcgcccgcggtctcttctgggcgagcgtgtggcagctgcctatcttgctggtgggaggactggtgacgaagaagggagtgtgggacggagtgtggaggaggatcgtgggtgatcccgaagacgaagacgaatattgcgacgaggaggaagaagatgaagcagacgtgcgtacctcgagatcagaatctgagaaagccgtggccctttcgactgtaagatctacgacatgaccagacctgttcacatttcgtttttcgtttcctattctttcttttctacactgtgagataagatgagcgggtagtgggtaggtcggggcgttaaaacgatttatttttcatttttgtattgcatgtattatatgagtaggtttgaaaatgtccatcggctgtttctttcttcatatacaccactcatagtttctcccttcatctctttgtcctttgtatctatatcctcccttatctccatgccaacaatgttatttgtttttctaatgttatttctggacagatgaggttgtgtaatatcataaaagatcttggagttgactcaagaatacctgtttctttgtgccatacatactgcagtcaggtatgcacattgttgtctagacgatttgctcaccatgagaggttgcaggcttgtacgcaacaggtccatattcttaattacccacgagatgcaaacaagacaagactactgaaaccagcacaacatgtctgacacctgatagagtggcttgtttacctgacgacgatactgtcatgatcacaacaccacttccctactccctaactgctacctcttaacacgtcctaaccatcctaacctgacaaaaacaacaacaggccttgctgcaagctactcagaaaaccgggatatctgcattcttaccttttttgagtctggtctaggtacgtatcccatttgtcctcaaaaaacgaaacgtgaaaaaaaaaggttatgcaacgatatactgatgatatgtgtactgtacaatccacagcctccagacgctcctctacacgtctcctcgtgtcgcaaaaatctcgatatcgaaatgccaaatcccaaacacaacaagaaaagacgtcgtctggactcgtctgcaagagacgatggtgctggaccatgcagacagctcatcgtcgctgggcagcgtgtcaaagtgaacgaaaaggaaggaaacgacctccgttatccgaaaagcatgctcaaggagatcgaagctgttcaccgtagtcttcaagctggtaataacagggcgaaaccaagctctactaagtctgctgctggtgctactggtgctggtgcagatgctgccgtggctgctgccgctccacacgaggtctttgttgtcatccatgaagaactctgtgattgcgaggacacaactttccatgtcatcggcacatacgctcgagtcgaggcagcaaatgagaaggttctggcggctttcagaatcatgcatcctcagttcctcatcgaagttatcagagatgaaaccagtgacagtgaaaaaggcagttgcgaaagtgatcacgatgatgtcgatgtcgatgtcgatgtcgatgatgatgacgacgacgacagtcactttgtcaagaaacgtcccagggaagggccctatccatacggattcgaggtcgcgtggtggatcgacgagcatggggccttgtcgctgcgagcgcaggatagaagtgatgatgttttcaaggtctacgccatcaggcagcaggtgcaggagtgatagatatcagtacggaaccgagttcgaagttcgatttctacttaaggtagacggctatctcctctcaaaataacaaaaaaaaagaggcaagaagaaaagaacttgaagttggcgccagcagggcctgtattttacactacactgcaattatgcgattgcccacatattgtttactttgagagagtacaaccttgaccttgcatgcaacatgtctaatttacctagatacactacaagcaaaacaggacttctgaagttgtagctgtttctgattattaccatcagtcgttattcctaagctgacatctggccgcaaccaggagccgtacctcatgcacagcatcatggctgtcactatgacccattttctgccgcctcgttctagacaactcatgctacaaggtcacccaggcctaccattgacagcaagtgatcagcctatccgcgtgagagatacaagccagcgtcgagcgagctccacactattggcactctcttctcgacgtgcatgctcacgagcgtcctcatatttcccgctgaggaatacaagccggccaacacgtgggtcttttcggaccacaaagacctggagcttctgaactggctcctgctgcagtgaagcctacgccatccgctgggcctggcgcaagggctgctcccgcgagcatctggacgacaaggacacgtttgacgaccaccgtcggccgcgtcagcctgcttcgggcctggctgacctgtgcggaatcaaagaccacgacggaagagactggccgccgcggatgctgtcgccctactcgaactcgaagtctcggtgacgaacttccccagtacgcccctttctttcatgggccgtctgctgccggacgacctcgagctgctcacaaacaggggccttcccgcgctggtcattctcagctggtggctcaagctgcgcgtgcggctatgtgctcaagcgtcaggaagggctttgacgccaatcgcattctagtcgggcacgaaggattcagaattcgttctctgaacgtcctcggaaatctcaatatttgggacatttattttatggcgcatagacgcatattatgtggtctctccctatccgttgcatgctagatttgcaataccgacagtaagaagatccatcaaattcgacctgactctaaaaacatcgaggctaggccgctgctgtatatactgccatattagaccccacccatcagacgcctggattatgcgcctcccatgggtatcctcttcgaactcgccagaaatcgcaaagcaagtcagaagaaaagataaaaaagagatccgaaacgccgaaacagaattcgaagactcaaccgcctttgataaagcagatattcccccgactatgtgcatgcacggcgacatgacccgaataggatggcccataatgcctccaaaaaatgccagagaaatggtataaaaatgctatatagaaaggcaatcttccttttaggatctatctgatcactgtagtaagtgctaaccagatgtagactgttcattgactgttccacgaccttctccgttggtcaccggtcatgtgatctgtagcatcagagtaaggagttcctctgctgccgtagatgaaccccggccgtggaaagacagggcgtggctggggtatatgaaccattggaggttgagtgattggcgatggaacctgcgtgggctgagtgttcatcgtgacttctgccctttggtccattgatgatgccctggagcgcgatggcaccagggacgtacaagattcgtacggaggcggcggcgtatcccttgtttccgtcgacgtgtgaccaaagctgctggggatggagaatgtggatgatgcgtcgtcagcattgggattctccgctgactgcgttggaggatcttcaaaatcccgtttgttcttctcatctggatctcggcgaatggcagcgccaggagcatcctgatctgggctcagctggagtgtcttctcatggacgctcacaggacggggagtatatctcggaagcggaacgacaggaaggtagccctccaccccttccagggcgggatcattggaatattgaggcgggtccacgtggtcatctctccgtacaaagcccgcctgcggatcagaggggacctgagtttggacacgtggacgctgcgaagcggaagacgcgaagcagccgcaaaggaggggcatgctgctagcggccctgaatgccggattggaaactgaagaaaggtgaagatctagatgtctctcaagaaaagacagttatagctagatcaacacgtctaagtgatgtcgaatgggccagacatggatgatgatagtggccaagaggaagggccggaacagggctgcgtgcgggtctggcaagtcttctgtcgattggaaggcggccgaggaaaacacggaacgaccaaggaaaagggggtaagaattggtaggtacagagacctagcgctcaaaaagccatcttcctgtcatctgtctgcaccctggagagtctccgagaccgctgggatgagcagaggcagatggagatggagacgacgagaggagagaggaggagcggacacggggaagtcacgggcggcgtgaggctctcaggcaccagcgttcatcgcccgccttcctattgggccgcgagggtccccgccgccgataaaaagcggcttatcgatacgatctcgcaaaagtcaggctagccgaattggggcgcgccctttctatttttcatcttctgcagtcccctctttgtccccgactcctgccctcccctctgtactcttatgaaccgccactgcaccgcgattgaccatgagtccggctctcccccccgactccgactacgcgaccatcgcccagctggtggaacctccccatgtccccccgcaccgctctcatgaccccgccaacaaccagaagcgcagcgacccattccaatttggatcccgctacctagaggaaggtgacgacgtcttcgaattcaatgcttgggaccacgtcgagaccgacccggagtacaatgcctacgccgagatccagtacgccaaacagcgcgagaaccccgtgtctgaatttgaccgccaccgtttcaactccaaccccgcccgctggtgggatcttttctacaagaacaatgccgccaacttcttcaagaaccggaaatggctgcgccaggagtttccagtgcttgctgaagtcacgcggaaaggtgccggtcgaaaggtggtgctggaggtgggagcgggcgcagggaacacggcattcccgctgatcatgaacaacgagaatgacgaactgatggtgcatgcatgcgacttctccaaaacagcagtcaaggtcatgcgcgagagtgagcactacaatgagaagcacatcaaggccgatgtgtgggatgtcacccaagagggcgacgactctctccctcccggattgggcgaagagtcggtggatgtcgttgtgctcatcttcgtcttctctgctctagcaccggatcagtggaatagcgcgctgcgtaacatctatcgggttctcaagccgggaggcgatattctgttccgagattacggtcgaggcgacctggcgcaagtgcgcttcaagaagggacgctatctctcagagaacttctacgttcggggggacgggaccagagtatacttcttcgagaaagacgagctggaaagcatatttggacggtggactcccgagaagggcctgcagctagacgaaacggcgcagcagacggaaggagagaaggaacattcgacagaagagagcaagggagtctttgaggttctcaatctaggtgtcgatcggagactgcttgtcaaccgtaagcggcggctcaagatgtaccgatgctggttacaggctcatttccgaaaacgtgtccagccagctgaaccgagcgttgaacaagctgtggaatcgaaagaatctgagaaacagaatgaagatgcgtcatgattggatctgaatacaaaatatagattcaatatcgagccaacattgagcgcacgccgtcattgtctgccgtgaaactggcagatcctcatctacgggacttcatgcccctacccagatatggtctgtctccaggacaaggcatggctttcccagcccttgcctgtttccttcgtttagataattggggaaaccaattatgccaaggcatcgtcgatcacatctggatgttcgctgcaacggcttccgtgcatgtaagacaatatctgtctgctttgacaacctctcaaaatgagagaaagttacgacgactggtcgaaacgctcgggttccgtattctaaacctgacacttccattgccccgggcgggctctgaaggactagataagagaaacgccacatttatctttgatccatcctctccttatttccaatcaatgtccattttgggggttgagtgcatacatggagaaattgacatggattagatatatagacatcataaatcgtcactattgctctcttgaatcgtgttctgctaccatgttgatgctgaacgccaagttagcgaacactagacgtctcacagtgaaatattaccctttgtttttggttccatcctacatgatgacttggatatcttcgaatcggtaagcttcaggaagggacgatgattcgtatctccgattcgcaaagagggctgcagctttcctcccttcgtcagttctggaggagaggaagggtcattttttgttgaaatccccttcctctagagcaataacccgttctgctacagcggcaacgatttctccatcccacattgcaggttcgacagccagacttcacgcggacctcccagaccgtcgatttggtttggtcgggcgcagagatggcccctcttcatgcgtaaaactgcttagtatccgctgaatattttatgtcattttcagccatatggaatggatgcaatgcaacccttggaattcaaatatagttgactcctgaggtcatgacacagaaatagtgagttttcctcaggatttgagaactggatcaagtaaaataaactgcaaaatccctagaaatatgagcccttagaaggaagatagtatggtagagtagataacaatgagatgctatcgaagatgagttcaaccaactggtccggttgaagggttcgcaaaagatcgattgttactagaatatactgttggaaagcacacatgcacttgcaatgctaggattctgacatttctaactgcgcgaacaattttacttaacggaatggggtaggagggatggggaggtttgtactcctaatgttttgtccattcagtcgggctggacgaacacttccaaaattggaaggttctcagcttctgatcaaacccgtgtctacctaattggagggctcgcaatctccaacttctcattggccgtctgagagctagtgtacataggccacccgaccaactagtttagtttccagaccatattagtcagcaaaaaaaagtcatgtgactaggcttaagggcccgtgcctgctgcctgaccatgactaataccaatactaaaattttacattacttacctcttaccatcttcttacgcctacctactactactaactaccattccctaagtacccccctatatgacccccctcccctcctaagttcccccctagtgaaccccctttaggcacctaatagcggcaaaatatagggattcttcaactaatttttaactgattgcgaaatgttttagaactgattctaaacagattaaaacaacataatattaaaatcataaaatcatattaatttatatattttatttaataattatatatattttttttagaattttatataagtagcttataattagtatataatcagtttaaaatcgattctaaaacatttcgcaatcagttaaaaaatagttgaagaatccctatattttccctaaccctaaccctaaccctaaccctaaaccctaaccctaaccctaaccctaaccctaaccctaaccctaaccctaaccctaaccctaaccctaaccctaaccctaaccctaaccctaaccctaaccctaagactccttgatccttccctaaccaccatcgttaagtatcgacgactacggttggacccaacgcgtaacacctagcccattaaagctgactaagcaactatggtcatctattattcagctaaaactaggtcatgggtattttaggtcatacctagtcaggctacctgcatataatagtggaacatgcaatctatgccaaaccaatcaggagcagaccccatatcatctactattccactgcccagcctatagagacatcagatatagagcattctctagggtagatagaaaagattataatcttttctatctcttttctaaggacggccaagaaagtttagttgaattcctaaaggagacaaaaatagccactaggaagtggcacataggaactaatgattacgcaagaaccctactacctagtctaacccatagaaccaggcttactaggcatagattatctaatcatgcttattaagccacctctcctatcctgactcccctttgtgtttttttttcctgttctttctctcatttctttttctttgttaaatccacctatacctactgttccttaacatttgattcttacattatactacagcctgtctctcattccctatttctgtccctcatagaaggttcccactgttgactggtctatagcataacccacctgtatatagatactagctactaagccctactgcctaggtggtaggcagagcgtgcatagtctctgactgaaaaacgctctctaaaatggaagaataataataataatataattatatttggagtgcaattctttataacggctgacaaactgattcacctacttctcactgatagaagctagttgatttagacatgcagagagcagcatctgggtcagatgtcatatagttgccaaatgtggtggtaatccttgtcggttcatatcaaggatccagaatttaagtgtagattctttagtattgctgagcttgcagcaatttgcagctatatcagcatgcacagttacccctttgacacatctctttaatgtttgttggagggacatcatatgctgaagtgctatacaaacagactgaattgacagcccaacttcaaagcgatatctctcaacatctagagcgtgcacgcgctccaagctctcagagatctcgcagaagaatccctactatagggccattgacagttaaagatgcaaatcgtcaggttgctgaacgtgctgaagctgaacgaaagaagattatttcccgtgtccggaaacgccaaccttcaaagccaattcccaccactacacaacggtcggatactgttgaaaatactcagggagatagccaggatccaggagatattaatgcgctatttaatgtatttagatactagtctagatgttgagaaaattgatgaaatattcaaaattggacgttgtggtcaaaatggacgttacggtgcaacgcaccaacacgggacgatgttggggcgggagcacgggtacctagttaggtatgtagtaaataaataagtagtagtcaggagtacggagtattccgtacttagtccattctccttaccgggattatcattattattattattatttattattatcctggcaaggatatccatgctcagcaaacaactcggtaggtaaggagtagttatctaggctaggtcttcttttttcctcggtaaaagaaaaaattaacagccaaccaacaaacaaataaccagggggaaggacagagagatagcatagcatggcatagcataatgggaaaaaaaaagacaaaaaaacacatatataaggccatcctatatacttagacagagagagaacaaaaaataacaacatgcaggtgataattaatacccagggaaactagaaactacatacatatccacccaactaactaataacctacatacatgtacggagtacatgaactgtacatacctaggtaactaactgactagtaacgaactactaggagctaacagttcactaactagctgctagctgctagcttatgcacatacatgcttacctacctaacctgaccacatggccacatggcaagcaaccacgcgagcgagcgggcgagcaatcgcctgacagctaggcaggtgggcagagtggcagacgagtgggcatcaatgtttatccaccagggcactctaaagaggattcccaaaaggggaagtttgcttattcgaccatgcgatcgttttgattgattgatcgtcgttgtcgtcgttgttgttatcggcagtttttgtctactgttattgccgatgacctatttattactccgttaggtaggagtgttagattagattaattaattagaaggaatataatctgggataactaattcatatatattgttatttgttaagttaatctgctggagcttactgatttagttgattaattattaatcttaatttaattgatttaattaatttaacttgaactgcaggtacatacagtagtacatacatctacagtacatggacggagtatcggagtattagtagagttattagtggagttatttattagtgactggattctggaggttagctacctagggaattgtttgcctgctgacttacttgttgtctgtttgcctatctgtctgtctgtgtgttgtgtggttaaccatagtgcaatgcattgaatgtactgtacgtatggagaatttggatagggctttttttttcttttggttaaattgtggatttacgaactcgtgaagatttaaatgtacctcatttcatgccaaaaaaaaaagaacagtatctactccgtacagcaggcacagcactgtcaaattcgatcccctgggcaaggtgatataagctaactctcctcctcctcatcgtcatcctcctccccctcctcctcatcataaacaacacccacttcacccgtaatgtcccatcggtccccatttgccgccgcactgacgtatttcacaaacttgagcgtgccgctgtcgcgcaggacaatgctcatccggttccagcccgcggccatgctgaacaggatcccatcgtcgtcgccagctgctttgtagatggctgggtcggacttgggtttcttggtcttgaccccgtcttcgttttcttcttcgtcttcctcctcctcgtcgtcatcgcctgccatgtagacttcgtatccgcccacggatggctcgtcggtcgtcttctcctcctcttcctctgccggcttgctttctccctcgccattctcctcatcttcttcctcgttgtcatcctccttctcccatccaggtgtaggcgtaagaccgatcgtgaattccaggcgcggctcctctccatcgtagccgctggcaagtgtgtaatcctgtccacgacggaatcgacgagccagcagattgtaactagtaagccgattcatgcccgtaatctgggacagccactttcggaacgcctgcgacgggagaaggtcgttcaacaactcctgaatgggcgacgacgccgccgcccctttccgcggctgctggaagagatagcggtgtttgtgcggcgggcgagcaaccttccagtccgtgctcgattcaatctcgtccgacgactggggcaaggcggccttttcctgctcctcgatgtactcccgcacccgagctgcgaacttgtctgatagcacacgctccaggctgagcgaggagtcattggcgaacgtttccgagagctcctcagcaatgtcgggcgtcaggtacgacggggagatgaatttgaggagaaagttgagatccgactccgaaaactcgctgtcatccgacctgacagcctccttgcctttgcccttgcccttgtccgcggcagcatcctccgactcccagtccaccggctgaggctggggctggtcatagatgtcgcctcgaccctgaagctgtgaaagactgctccgctccgccagcttctcctccagaccctcctcatatccgtcttccccttcctgtgggatgtgataccatccactgatggccatgcgcactcgcttctcctttcctttctcattttccgcggggtggtagacctcctcgacgtcgtggaagctctcgcctggctggacggtgaagaaactgagctggttgaaggctggggggatcgagaggctatggtcagggctggggatcttgatatcctcccctttctcgtccttgacggtcttcgtcgggtacagtcgcaacgctccaccccattctgggcgccagggattgtctggatccgtcagatacaggatgtaactgagacgcctgctgccgatgacatcgtcatggcagagaagatggcacccttccgtgtagatattgatcgccatgtccgttttgcgaccgctgagtttgccggacccggtcaccgaggcgagatactcgcgaaatttctcggagtagagcgcgtcgcgcaattgtagaagagacggaaggcgcgccagggaggcatcatccaagccatccagattcgcgagatcgcccgactggaagattttgtagatatccgtctctttctcagtgaatgacaggtgctcttgaatttcattgcggacggagcggagcagattgggctcgatcagcgggcagatgacaccgtgtttgtatctgcacgacgaaaaaaatcagttgttagcaggcacaattggtccaaaccctgcaatcaagagtcccgaaatggaacctacggccccgagttcgcgtagctcttcttgtacttgtcgagctctgcaggctcgaacaatccttcgcggaaacgcgcaataaccatgtcatttgtgagtgcccgcttcttggcccctgggaggccattagcgtggttgcggtcttcggtcttgcgcttcattttgcccgttgactggcgccctggaggcagagcagaatgaaggtatggtggttgtcttttttttttgcggagtttgggcggtgagaaaatctgccgcggaggtttcggggccagccctaacgacacctgcaatcaacattcatttgccagtcgataactaggctgtcttttttactcgaatctaagcagagtgtgcagtccagattttaaagcataaatccatcagatctactgcatcatgtccgctttggtatgtactgtacaagggaagggtccaaaaatctatgtgcaatgaaccgcactgcaaactgcccaaattcaatctctttggcatagaatgctatttttcatttaggagactctgccaagaactaacgagagcatgtttgcgcatgctaaaggcctggccagccgttaatatgtcaagttcttgcagacacgtcattggccagtcttgctgtggtgctccctgtggctgtgccctctgcggtggggtggcgagattactaataacaactgcagaaccagatgatgtcagcagcagaatcagcagacagcacgcttatcgatttgataaggccaaagcaagcataacggaccggtatagatatagacaatctctgccgtgaagtgctttgactgggggacgaatgctgagtaagacaatggcatcatcttaatcatccggatcatcttgtcgctgcgcttggcgcccgttttgcgggggttgtcttgtttgccgctggatcgcctcaacatcaactacatatcgcctctctgcactgcgtttagagtgctttctccttctcatccatatgatatcaagcgtcatacgccgggaatgcgatggaacaatctcaggaagagccccaaaacaacgagcggccaggcaccccgccacgcccgccgtactccccggtgacgccagtgtttgcccatctggcgacggtgcccggtgaagcatcgattgtccctccgggccctgaaatctctccgacaacagtccacacgacccaaggcggcatgtccggctcttttcctgggagcgctccccagcagcagcctgttactttcgcgccggagcccgctccggtcccgatatcagagagtgagaatccggacgtgattgccctgcgctctgccatatctattctccagcttcagaaacagaagagccttcaggatatcaggacgctggacaggctgaagaaagccgcggccgcagatccagagaagttcgcacaggagctggtcgcaggccgtctcacctcggacgagccaagcgatctggtagatcttcttcctccgggccaagataacgatggcgatgacgcgtcttcgaataatgtgcgctctcagagggcggagggggccccagctttcgacaaaatccccaagcctcagaatatcgtgcgcatgcccccgatcaactgggccaagtaccagattgtaggagagccgctggacaagatgcacgaggagcagctgcgacggccgtctcctggagaaccgcgacgggatgatacggctcagagagcaccagagcatgtgctggcggcgccttacagaccgctaacagacaaactggacagctctgccaaaggacgaggaacgaaaaaggacaagaagacataagaatatgctttcagcacgtcatattgatttcactgagcatcactacttctcagtcagtagtccttattggacaagtgtgcctgttttatgaacatcaacaacagaaaaggcatatccttcgcacagacttgaatgctgcgtcgctccacatttcgaccatagaagacatgagaacacaattttcagaaccaatatcacccatcgtgacttatcgacagcgtcctattgttaaggacacagcctccagaagcttaaaatgagcctcctccaacctcgaatcgtttcctcgaccacaacgcttccgtttctgtgagacaggttgtaagatactggcgtcttcacactgcaggggggtagatcatacttcttgttcgggttcgaatcttccttgtccaattatttttcatttaaggcgttcttcgcggtggaagactagcttgaccatcccgaagtcctctttgatggcacctgcggaaggtggtggagtgatgcattgtattcttccgaggttgattcgtgattttcctgctgctatttcattagcatgtaattttttttattttacttgatcgccatcttttttttttcttaccggaatactcgaatcgtgcgacaccgattgaggttcctgttgctccatcggtcccataatcttaggaggatacggagcaaatggaaacggtgggaggacgggcagatccgactcgaaatcatattcttgcgggggaagacaaaactgctctcccggatagaaagcttgcgattctccgatcgtggtctttgcctcgatgagcgactggatatccgcgagcctgaacggaatgaagacaattgaattctgctcgacgttctgttcgacgttctgcttgacgtgacaagcgtcgtctgaataggggttgtatccatgataaccgtcagcaggatagccatcttcaggattgccgacttcgaaattcccgctgtcaggattgatctcgctgtcaggatccgcgttgtcttcgggattccattcgttgtcaggattgaattcattcatgctgaagatctcgccgaggtttcctggcgtctcgaggccgcagtcgatcaacagttctaggaattcgcgctgggggctgttcatctgctcgggatcgaaatgctccgcgccatcttgattgggtgtcgacggcctgcgaaagttagctgtatgacctcaaggaacagagcttggtatgagtattaggggcattctggccctctttctcttccgccctttcttctgagcgagtgtttctgtcaagatatcttgatcgaccagcgtgctgtgtattcctgtatgtatttaccttgaactttcaaacggaggatcttgggatggagattgaagcgtcatttttcagcgactgagacgggctctgagacgggagatatgaaacaaaaaaaaaagaagaagaagaggaaacgaggaaggttttataatcttagcacatgagatgatggacacgttcaaataatgtcttcacggactgtttgagatgacggaaatcaaccactctgtcagaggctttttagtgaagaagaaagaacagagacagcaacagtgacgaaattgcttgtgctgtgacggagagaagagaagagatgaaagaaaaaaaagaagacacggagctttcgtcccatgtcagtcctggtatagatagggttaggttgtcgtaggcaacgatgctgctatgtaccgtgctgatcttctgattcacctgacctggctggattcgtggcatgagccgagaccaaggacgatattcttcgtacaggaggcaagaagagtgacggatgggatggaactgactcagaggagaggggctacccatatggaaagcagtaagctgacatagatgtgcccggtgtatgccgtatgcttcacggagacaggctcacaaattttgccatcaaagatgcatagtgaaagtgacggcagagcattcatcccatgtgctgttgggtatgtcacgtcttggttgctcttgccacttagttatatgcctacttcttgacttcacaagtgcctttctggggcgaacatgaatctacttctggaacgtgaatacagagaaatagcctcactaacttctagccacaaactacagtttgacccctccatccttgccctgcgcttcccaccgcttcaccctgctcagtgcctcctcggagttggcctccttgatcttttccatccagtctcgccaggcctggttgccggcctcgtcgtccaacacggccagagtctgccggtacaagccttccttcagggccgtgtacgctggcgactggcccagcgcatgcagcttgcggtcctgaacgagcttgacagcctcgtcgagcccgcccagcgcgtctaccaacccggcgctcagcgcctgcggaccggtgaaccgcttgccctcgagaatcaacgaacgcagcgtgatcgacgacggcaccttctcgcggaagatgctcgtcatgggcggctgcagcggcacaccgagttggatctcgttcaggcagaggaatccccgagaggggttctggacgcggtagtcatggtacatggccagcatgaggccgccggcgaaggcgtggccgttgacgagagcgacagttgggaggggatatctttgccatcgtcagcacacataatcagtgcctttctacggcttaataaaaaaatgcagaggaaaaactcaactcacgtcagcaacctccgaaacagcttccacagatacctctcccagaaccagtctgtgctcgtcaccacctccagatccaagccattgctgaagaacttgccgatgccgctcgtcgtgatgacgacgcctttcgggaaccgatgctcgatgatatccagcgcgaggatgaaggcgtcgatgaaggcgggagtgagccggttgtcgggcggcgaggtgaatgtgagcaggtagatcttattttcatttgaactattatctcctttcttcttgcctgtttcttcttcttctggggtattaactgtgctgcagacgaaggtcccgcctgtggagatggggatggagaagagtgccgtcatggtttttaattctttgtcaattttcttgattgtagtaaatatctctcctcttggacagctgtcacaatctgttgtcttttcccaattcttgatttttattctttattccattgctgtagttgtgtacattatctgggcaggaatattccagcctagaattaaatatttatgtacgcttccgaggtctatcaaatcaacgaaccgaaatgccgagcaggagctaactatcgataattttagtccgtcctggctgatattaattaattatttttctgattactgatctgatcgtcagatgccattgatcaattaatttggtcaatccagtggagctagatttaactcttttgtctttgttgatagtagttaaagagtaggaagagggggactttcacatgctgcggaaacctacctaatagtttctctgctagagaagaatgtccaaccacacacaatctgaccttcctgaccaggactatctatcgatacctatctaggagatatacctaggtatctaaagattatctctatttagaagtaaatatactactactgaattagatctcagtttatggatgtgtgtgaaactgtatggtcttcgaattctccaccgtcataaaaatacataacacagtgcatctgtactgtacacgttcctaaatatgtgcataacttgtgtatacaatttatctctctttattttagtttccgtggaagataagttggtaaagcagatggatcaactttgacgtcattggcatatcactggattatggctgtatattgaactgtatcactaattgaatgaagaacggagagcatctctttgagactacaggggctgcaattaattgttatgtgcaattatcgattttacttctccgtctccagggtcttgtgattgcagatgatctatttctggcctgactgtcttgatctactgccatatagtcagtcttctatacacaaacagaacgactacaacgcatcgactgcattcaatcgacgactgcacttcatgtcctcgccaacaccccccgacaccccccaaccccccacgcaagccacctacacgcaacccttgaaccccgtctcgcagaaccccgtggaacaactcaccgcgtcggccaccaccacgcgccgtcgcggcgaccctccgcccgccatccgccgcactccggactcgcggccctcgtcggacgtccaactcgcccgtctcgagcaggaacgtcgtcgacagcgagaacgcgaggcccgcagcggcgctgccctcgacactgagtacggcgtcgaacagcagccggatgaggggtacatcgccgccgccgtcgaggggaagaatcagtacaagcgcgcgcaggccggggcgcatgcagggcccgtgggaagcgccgacggtcccgggtttgtcggccagcaggacgggaacacggcggcgcagttggatcgcaagagggaggagcacgatcatatcttgggccggagagcgggtaagagcccggcttttgatggtggtgattccggggaggaaaagaaggagaaggagagctctgaggatgtccgcgagcggcaacagctgcgggagaggaaggacaaggagaaagaggagttggatgttaaggggacggtgagtagtgggacggggaatgtcgtggtgtgatggaggagatcaggtcatggcatagtatagtgtgtctggtacgatcggatcgacatttttcatctgtacagtaaatacacgactgcaagcaggttgattaattcaccaaattatgatttcattctatcggagcttcctgtcctgcaatgcgcgatatcacaatttattagtagaacagcctcatcccacttgcgtattccagggtatcataatcaacatgtaatcaaacaacctgcatgtctgataacacctcgatgatctctatctcgacgaccgctatgccagctaagtatctgcttcgctctcgccgatcgccgccttcttcagggccagatcttgcttcagttgttgcacgcgctttcccatcttcatcttcaagatcgaattggtctgtctctcccaccgcgccgtctcttcccggatgagctcttccatctcggcaatcatctcccgtttctcctggagctcgcgctgctgtgccagctgctcctcgtcgagctccgcctctggagcccctccgccttcggtgtcgtcactctcgtcatctgatgtatcttccgctgccttggtggcggacggtgtagcggcctggtcggccgctggagtagaggcagtctctgcggctccagcctcttcgtcggctccggcggcgagtgcggcctccatctccgcagcgaggtcatcctcgaagaggtcgtcttccccagctgcgtctgcctgcatgtcctcttccacctccccatctgcatcctgcgtatcgtcgtactcctcgtcgtacgctccgctctgtaccatcccctccgctcgtgacagtgaaccaccgtcaaccagctcaaacttaggcggcttcagagcagcctcatccttagcaatcaaatccgcaacctctctctccacctgttcaatcgtgcgggtgctaatgcggtcacggaaccggcgttttctcacccatttcagcggtggcgtcaggccatgcgggtactggtaggtcttctcgtccagcacgtccacctcctttggaagcggatattccatggcttctttctcattctggacgggtccaaggacgaggagcatctggcagatatctccagccttgtaaaaggagcgtttgtcccagctcttcattccctcgacgatgcaaggcaggtccacgagcgtggcggcgtattgtctatcgcgtatcctgaagatcgcgcgccgtccttcccgggtcaggggcttgaaagccacctgtgcgcggtcaatacgtctctcgttgatcacctgccggaggtattcgcagtcctcgcctggcaccatccgtaggataaagttctcctcaatcgaggggtctacctccgtatcagaggcttccgagtcatagcccacacccagcggtcgatgaggcaccgagcccttgtgtttgatccgtagcgattgcacgccaggctgcttggatgggttcagcttgaggcgtttgggacctggcttctcctccgcaggctcggcgtccgactcgtcaccggaggcggcgtcagcgcgtcgtttcttggacgcttcaggctgctccttaggagggcgtttcttctttgccttgtcgccgccatcatcgcctccagtaagtttttgcgggccaaacttcagcgtgagcttgggctgaggagggtcggggttggccgtctgcggttccgccggaggttcttgaggaggctcttcattgggcgtcttcttcttgccaaaggtgagtttgagggacggccgcggagcagacatggtgaagatgaccagaaacactcatacagctcctggagtggctgtagagtgatcgaggtgaagggtgtggtcggtagaggcgagtgaaagagaggcgggaaatcaggtggtccgagtgctggcggcgcggatgacgtgcggagagctcctgcgaggcagctttcttttatctccattccgctcattcttcccagcacagcctacgccatggtgctacgctcgttatcctggaaattaggacaccgctaatttatgctccgtcttcaaggaccgattcatctctctggtctcgagctgcggatagcttcttttgcccatcatgtccgggccgaaccttcaccatgctctcctgcgaccgccaatcattcagatcctgcgcgctgcaggcttccattccacgcgaccgtctgttcttgacaccgtcgtagatatcgctgctcgatatctaatgctgctcggctcctctgcagccgctcatgccttgaacagccacccagacgacccagcgcccaacctggatgacatccgcctcgccttgcaagatgctggtgcgctacgaccgcagatgagggatacagaagagacatggcgaggggaagaagatctacgaggcctcgaggcgtttctcagctggtttatgggaccggcgaatcgcgagattcgacgcatcgcgggatttgtgcccagtgaaggcgacgtgatcgacgccgattctctcgagaaggaggactacctgacggcgctgaagaagaaacacagcaagacaggcgaggagtcgcggtatgcggggaccgtcctggggaaggacgccgacccgcatcctatcatcattgaaggcggtgcagctaccagcattcgagaatggggcatgcagatcagggcacgggagccttccacggagagtgtgtcgtccgccataagcagtgtaccgagcagtctttccgatgcagaaggcatggagatatgatgcagcgtgagatacgatctacttacgacctaccaaaaacatgcggaataaagataacaacgcatatcaccacacttgtgaattgcttgaagtgatttacaaggcgtcgcttgacaagacggcagacttggatatcgagctctgagacggtctgtcaagattctttcacgagaggctttaaaggacggctctttgtccgccttctgactcattctgacccagagagagagctattcatctatcagatctgttgaaaatccacaacagatactgaagcaaactctcggagtccaactttgcattatgattcttctcccgtgcagccgaaatgaccggctggacttgcaatccataagaatgcgataattcgaatcgctaacgagagtggcttggtctggcgcgggggaaaggaacgattacgagatacccaggatacacgtactgtacatagaattctaaaagacgaatggacgtctctataactatttcattgccagaggctgtcttgtagttgtgtggaattgcctatagtaaactcttggcttctagaagcatgtggtggtggtttcccgtgacatcaccgcatttactccggattttggagctcgcccgcattttgtctctgcaccagggaaatccctccttgcgatcactctcacctatatatattattagaattgaatcaccctatagaatggtatacgccttccccctcccgaccacctcccatctcgccttccagacctacctctcgtccagcacccacccctctctcccgcaatctgcctcgacggcacgacatgccctccggctggcgctgaagacgcacaagcgactaccaccacgggaacgggagacccatctccagaccgtcttgaatgctctcaacgagtatctgccttacctctttgcgatttcccatggtctgagcggcaagactgtcgggagcggtggtggggtaggcgaggaggtagagatcacgcttcgtgcagagattgaagtcgaatggcggcccgtcttgacgtccagctcatccctgctgaaggggatgcgggatggcgggcgcgtgaagggccgaggcctcgatttcgagatcgccttcgtgctgtcaacgttgggatatgtgctgtcgggtctggcgagggtcggggtgctgcgcaccttgtacgccgcctcaactccaacagcagagcagcgcactgctgctgtccaggctgcgacgaagcagctgcttcagaccagttctgtgcattccctgctcgcgtcctcttacaatcttgtggtggagggttctgctacggtgcccgatctcgactccacgacacagtccgcgctctcgtcgttggctctcgccgaggcaacgctgctggcggttctgaaagatgatgcctacacgtttgcctgtatccaggctcgcaacccgcacgacaaggactggatggtccggccgccggagattcccaaagtgcgagcgctgctgttcgcacggttgtgtgttcgcgcggctgagtatgcagagcaggctgccgcgggacttgggtcagtgggagccgggggtcggaacagcagcagcgcagcggggaagatcgacgaagatctagtgaaatatgcacagacactgggcaaggtcgcgcgggcgaaagcctgccggttctttggcgtggacgcggagatggcgggcaaggttggagaggggatcgcatggctgagagcggggaaaggcgctttggggttcaagcgggcgctggcgcctgagggagaagctacaggaaagggaagtggtactatatcccggttgaaacgagaatgggcagaacgcagagaggagcgcaagttggagaaaggcaatgctggaggaggagcaggacacgacggtgagttggaccgcggagacgatgccgggtgggaggaagaatgtcgggtgctcgacatgttggagacgaaatgggtgaagatgaacaatacagtaagtcagaagaagcccccatgggacgtccgctggtgaaattatctaaactaggaggacaggttagctcacacgtcatcccaccatctgcatctctgctttcgaacctgccttccggccgggatatccatagtgctcctgcgccatacacgccgccgtcgttggacgaagatcaactcgtccgcatgcgggctcccccggacgagggggagcagcaactgcccgggatggatgacagtgatgaggaggtcagtccaggggaacccccggcaggatttccctctaggcctgtgacgacggacagtacttatttttgaccaaaattatatgacacatgatcattgcttgaatgatgagatacccaatatatacttcatgactgaatctgtgtcgtttgtatacgagcagagacaaaaggaagactttaccctgcgccgaaaatggactccattgactaactcggaataaaaaaaattgatacatatgtacagtgcatacaagtattctccacctttccttctcccgtacaacggccaccgtctagacagtaatagccagcaaagccgcaatatcacttgtgacagacgggtcggcttgaagttggcatcgacagatcatcaacacaaaccaggcgtataccggtcaattcgagacgagaaacggttcagcagtagacatgagcgtatagtcccggtcgaaaaaagaacaccgcgccgaatggtcgtaggtatgcgtaattccatcttcgcaagcaagtacccctttctcccgtcgaccacagagcttattgcaaaatctgtttttctctttgtcttccttcacaggacgaatttggcgctattatgacgacttggcctcctcgccggccttggaaaagtagttcttctcctcgaacaggtaacccttaatcttgcggtccctgagaagctcaaagtatttttctgtaacagcagcaaaaacaaaaaaaagaaatcagcaatgacacatccagtagagtataagaaaagcaaaaacgaaaaaaaaattcaagcagagaaatcttcttcttcactcaccccgcaacttcccacacttctcgagatggttgaccccctcgcgggcgtagcacttgcccaattcctcgcccaccagccgggacatcatgctgcgcacccactgctcgcggatgatcgcgtcacgggcattgtggacggcgacgttgtcctcgaagtcgacgccgtcgtaggtcggcggaacggtgggcttcttggccaggaaggcggcggactcgggggtgggcattgcgctagacgtctctctctctctgtgcgtgtgtccgagataatatgtatgaggaggaacttgagtaattggaaagtggctgttgtgttgtctggatttcccaggttcagctcgttctcgcttgctccttcggagagaattaagcagttaactgctgcgatccatatcgtcgctggagttggtcggggctaatcgttttcgggatgatgtgattggttgagagcgaaggcggaacggactcaaggcggcagaatcgttcttccattacagtacggagtacaaccaccacccgcatccgacacagtattactagctatgaattgttcaatcagtaattccaatcgaatatcgagtccgtctctgaatatctagttgtacactagaatgtttatgtttcgctatggaagtcgttctagcaatggcaataactacccgcacatccgcccgcaactgtcagctatatatatcgcggcattgcgctttataacaatgaacttcatgcttaactgccaatttagattgacctctgaactgctagcggaacaggtcagactcagacagggtctgtctggcaagctctttatttgatcagctaacctacttgacatccagtccaccgagcctacacatcaggccaggttctggcaaggccatgcatgacttaggtctgtaacttacctacacatcactttgtccgccgagagtgtgcatgttgtctagttttggtgaggctgtgatcaggtcagatagataatctaccttacaatctacccgccaagatcattgatcaagtcaggtcctggtacataaagtctttgattcgattagctgacctggtcaccactttgtccgccgagagtatgcgtgttatctagcatagatcaaatagataatctacctctcattttaccagccgagactatgcgtgctccttagtcctggcatgccagcctgctgcccagggtcagataatctacctacctaggtacctacctcgcaatctacccgccgagaccacgcatcagattagatttcgacgtggcccgtgtcagatcagatcagatcagataacctactcatcattctgtccgccgagactgtgcgtgttgcttagtgctggttcagcctttgagcagataatctagataatctaccttccaatctgtccgccgagatcacagatcagacaatacttggacaaagcgtgcccttggctagatgagataacctacttgccattttgtccgccgagactgtgcgtgttgcttagtgctggtcagataatctagataccttgcaatctacctgctgaggttatacgcaagatcaggatggagtctttggtctttgatagtccttgcttagtatgagcataagctcctgcccagtggttatattccagtcctcttaatacatgtagaggtttcaagcaagtcctaagaaaagaattgcctagtgtagtgtagaagtgtgtgaaagactcggtcctttgtcctcctttttccaccttctttctgtctttatatgacccaagctaacaggagggccaggttaacctctcactttgtccgactctttgccaagcagtacattaatgcaactgggttttatttacctagacttgagtcggaaacctgacctgaactggctgaaaaactatcgctttgtccgactcttgccaagaattgcaataagccaataactggctttattacgacttacttgacttgaaaacctgacctagtcaaaaaaaaaagcaaaaagatccctttctctggcagtcttcttttatgtaactaaactaaattaaccttgacaggaggtcagtcatgcaagcaaccaaaaataaaaccttcattctacacgcctttattttataaagctgaggataatgaatgaatggactccagagtccagagtcagagtctttcagaggcctaatgcctatttttactcttgagtattcagccatctgcccgggatttatttttctgaggaacatccatggattggattcaacatatatcctcatcgatggccaaagaggggggcttgggtaggtggttgttgctgttgttgccttctgttacttctattgatatagcatggcaataatctatggtgaatcaaccgggatcacggtaaggtattgtgtacatacattcgtgcctaggtagggatggcagtcaaatcctcttgtctcgaagtacatacagtacagtgaacagtaaatagcaaaagatctggagctgatgccaagcaggataagtataataagaataataatacatacatacatacatacatatacatcaagtactcaaacattaggtacacagaccaggccagaccagaccattaacataactagtccgttgagaaaagaaaagaaaatgaaccaaaacgcagaaaaataaagcacgcattctaacactccttcaaatctgcataatccaacgccatcgacactatatcccaagatcacaacaagatcatatggatgcaatgcatatgtaatgaaaaggcgtagtcatgatcgctgaacataaagacaaataaattcgatcaaaacatccatgcgcaaaccttgcggctattgttattgctgctgtccttgttcttgctcttgctgttgctcctgccccttctcttcccgtttcccgaatatcttcttgaacaacgcgctgagtccgtccttgaatcgctcccaccgcgtccggttcagccagttgctcagctcgcggtacttgtacatctcgccccaacagtcgcgtccccattggcatccggccatgttgaccaggaagtcgcgctccttctcctggtaatggatccccagattggtcccatccccgcacgcgcccggcgggaaggagttgatgcgtcgttgcgggatgaatgccaccccgggtcggatccacggttgatgcgcgtacagatattcgagactgtcttgttccttgtgctcccattccatgtgtttctgctcgtacagcaccggatcccaccagatatccaacagccggtccgtccacacggaacggcgcacgaagaaagaacccaggttgaatccggcgcagtcctgggaaacgatgaggttgatcgaggaagggtcgccatccccctcggcggagagggacaaaggatccaggtagaagtcggttagaggatgcgaaatgttgagagggttgtagacattgatgtcgcggtaggtgtaggggcccaagtttttgaagacgtgatcgtggagggaatacgagtactccatgataaacgtatgtaaatccaaccaccagaacctgtttcggacgtcaatgacgatccagcaaaggaaaagagaaaggcacacataccactcggcattcggatacttgcgcatggcttcccgaatgacatcgaccttttcccagctctcgcgccattcgtgggcataccgcttcttggccaccatgttgacaatctccagctcgtgtccccagcgtttagcgtactttttcttgttccacaggctgactcgctcaatcgcccattctcgcgctcccttccactccatgacgcctccttcgacattggactctacgatcatcacaattttccgcccaccgcctaaagatgatctccgatacgcttcgacaatggctagagaacaactagattagaagagttccagtagcaggaagatgaaaacatacgctcccagaaattcaagtagcagacgaataagacaatcgccaatagcaacagcctaaaccccttgcgacgcagcatcgcactcacaaaggagatcagacggcccttccaactgccaccaccgccctgccatcgtccgcggcccagcttctccttctctcggtagtcgtgcgacagggtgagggtgaatcgcggcaggctggcggagatcttgcgcttttggcgcgagaagaaaccactgttgcgggtcgagaaggagggatatccgcgcacctcgtcgctcttcgctttggcagccgcccaggagatgccgctggggccggtgggagtgtgagagtagaagtgaggatcgcgaggactggcgccgccgctgcccggcgtcaggccgggactcgaccagcctcctcccgggaggggggagggcgatcgcgacagcgacatgggcgagcgagacggatcggagggagtgccaggaatggcgggcagcggagagcgggtgaagggtcccgcggagaggccggaggagctgccctgggccctggcctcgcgcgcgggcgacgcttgctgcaggcggagtggcgggactgaagtcgaagaacggcgtcgatgatgggatcccgagacggcggaggaggagcaggaggcaggactcagagacgacgagggatccagggtgggagcgaaggtgaggaaatgggcgaggaaattaatttaattcaaattagacgtgtggctgttctcggcgtcgggctgcagctgcaaggccgatggtgtgagagtcgatgcgatgataacagcaagaatgcggagtggattcgtggccgccgcctatcgctcagctctgcttccgggccacggtgatttgacaattaactgtcaattgcacgttcagcgagtcaggcgattcctcgtgcggtcaaagaaaggcgagcagtgagacagggcgcgcctgaggtcagcggtggctggcagccgttggtggggtccaaggatgaagaagaagaagccagatcgcagcagacgcgctctgagaacagcgacgacaggatgcagcacaggaagatattgtttattaccgcgtcgaggacagatacaggcggtccagagcagcgcagcgcagagcgatgggtccgcgaccctgactgaaccaggcagcccatgccgaaaacgggcaaagggcaatagcacgaggcccgaccgagaacaatcgctcctagcgcgagtctggagctgttagcctgttaggcgtcctagccagacgcaaaagggcccgtgtcgaaaaggagtcgcctcagtctccatcgtgggcctccgccatcgccggactgagcaaggcaggcgatgagatcctgcgccaaggctcgaaggaggaaacgcagttccgggagaggaacccaggagagggcaggcaagcaattccgacatgttgaggacagtaatagtaataatcgagcggacaacaggcatggactgttgctccgaacagtcgatcaagccaggaagttgttgatgcagtcatcatgccatcgccatgacgggcgcacacgaactcaatttccaacagattgagcctggggcagccaatacggacgaaattccaatctttcgcgacaacactaataatcgcgcttgtttggggccagatcctagatggttcctacctctcgtctacggtaacattatggacaggaatcggcaagttatccgcatccttcatctcataaattaaggaaaaaaaatccccgtgtgcaatgagaccaaaaaagatctggttcttctctgatcacacaaaatacaagcaaatatatattagcgtcgggccagtacaatagcaaacagtatacgagccatgaatgcttcctgttttctgtttcctagttgaggaatcatcgttctaatccgtaaattcatatcggaccacgtgtcccatcagaatggaatctgcgcatcaaaggaaagtaattattatgcagctgatgctccatgacaaacagcaaaaagcatatatatactgtcattgtattagttcatgggctcagccttcttttctcattgcattgcattaatttatctctgccagtctttccgacacctccgttaattgttattggacaacacacccctcacaaacaaccaccatatcgatcactcgcagcaacattactttcaaaaaaaaaagacggagaaagagaagaaagaaaggcgtttttgtagcgccctagatctagatctaactaacagcttaaatgactggtggtatgagaaaataatgataataacaatatgccaaaaactaaaatttatttatttcctcatgactgcgttcaacatatctatctacctatctagatagtcatcctttccattctcacgaactcaatattatcgacacgaaaaccctcgacaatgcgcgaatgaccaaagagaaaaaaaaaatcttttccaagcgtaaggatacaacacaacaaactttctatcgatcaccattccacagttgattagggttagtagttcgtaaaataatgtggagtacgagtaattaaattattttatcaaggcatccagttgattggattattgaatcaggtaattaaattaaacttttttttaaaaaaaacttcctatttgtcgaatcccgagatttatttgttatgttatttgttatcgttacgcacgcgaaatttagcccctgacgattgcgagaacgtgtggggactgctgcacctgatgaaatgatatttactagccgaggagaatgagcatctactccggagtacggagtcatgatttgatttttacgaaatccggattttacagacatagaactgaatattaaaataatgaaattgaatagcatgctgtaatttttcttcacttttcatttactgagcggtatttttgttcaagattttgcatctttcatggtatagtacacagcatagaccgacagtacctagtaaaaaaggaaaaggaaacaaaagagaccgatccaaaggaaataaaataaacagtcaatgctggagtagagtcatgccaaaaatattaaccaactccctacccaaaagaatttaccccgtcatcgtcgtagtcatctgcaagagtaaagagacgtcatatatcccaaaaagtcggacactgcgtaatggtgtaccgctgttcagaatcacctattcggatgacttatattcgccatgcagcgaaagaccaaccaaaaaaacaaatcgagataagtggagattgtaggcttgctaatcagcagcaggtcacttttcgaccttttcgaccttttcgactctttctttctgcttgacaggcgtctgctggttctggctcgaatcggtcttctgcatcagcgcagtccgcacgataaaccccttttcattctcgggccgtggacgcgcactgtcgccgtggtagaattcgcagcggaatttcaggtaccggtcccggtgctgggggtgctggtacacggtgatgatgtcgcctgtgtacagcttgccccactggaagccctcgcggccgtccgggccgcgccgcagttccaccccattcacccagatgcacttgctggtcttggtcgagaggatcgccgtcacgcctgggatcgtcatccagtctgtgcccgccgcgatgagggcttccatgcccggcttccagaacgttatctcaagtgcgtacagcgggattcgagcgtccatcggctttgggtagcgcaccgtcgtttgcagtccacggccccacgaagtcatccggtcttccaggcggatcgtgcagtcgaagatagagccgggtagcgtcgtcaatttacccaacagaggtcgaggtttcgaaaatgcagaagtggatggggtcttggaattgtgctgcagagtcggtcccggaaagttgtcactggttgccccatacgaggtcgctggcagatctgatatttcctttcccgtgcgagcatcgatggtcgtagccaattccgcagctactcgcttgtgaagttctggcttgggattatcctcttcatcattgctgtgtacatcctgattcgagctttcgctagctgtatccggaaggggaagctcgatgcgacgacgtaacgggatagccttcggtgtcacctcgttaggattcgagttctcctgattcgcttctgggagatcctgattagcaggcgtcgcctctcggctccggacactacgtggcgtggctggagtgttggcagcaggagtcgccgggttggaagggccgttgtccgaagacgacatgttgagccgcccgacgagagcttcggctcccatcaagctgggcgctgagcctccaaattcgggcatgggggaggaagatacggcggtcaagccgtggacgtcacccatcgactcaccactagaggaatggaagctgctggaactggcgttatcaattccagagaactcgttcgggtcgagatcttcgagaacctcggcattctgcaaggcagatgcggtaacctccccgaataaacgcttgggagttttctggtggtgaacgtccgtgtctgagaagctctcgatgtgtggaagtgaagggtaacgaatttcagcctcctccagacgcggtctcttcacctcgttttcagtctggctgtttttctgcgagtcttgctctttgtcgaaatcgtcgtggatggagagctgggatgcatctagctcttcttctactgtctcttggatcatgcctaatttcttctgctcagcgggaaaagtctcgtcatctgaatattcatcgatgtcaggaacatcggcaatccatgggtgttggaagcattcctgttccttgggacgagcctgggggtcccggttgagaagcctcgacacaaaatcaatgccctcttcagagacaccctccctgcggagaaggtccagatcagggtctgtcgtcatgatgttccgcagcatttgcgcgcccctgtcatcccctcggcccacataaggaggtgagccacaaaggatgtggaaaagtaccgctccaagggaccacatatcgactgattgatcgtaaggggatgttttgggaggcctagtaggacagattgttagctggatcctaaattccaatccgaaaagaaacgatgaacacgtacggatcaccaagacgacgtcttttcctgacaacaccttgtcgatagttttcatactctggatagacctctggagcacagtataggagcgttccgcagaaagtcttcaggaacgtctcttcctgaacaactttggaaaggccgaaatcggagagcttgactcggagtggatcgagggacgcaatgaggatattgtcgggcttgatatcacggtgggtgatcttgcgtttatggagataagccaatgcgtgcaagacctgccgggcaatgatcttgaccatgtcttctgcaatcttcccatgggtctgaagatatgtagagagttcaccgccagcaacgtattccataatgatgtagatccatcggtcgtgctcgtggtagtcgacatattgaacaatgtttggctgaaaacaataagccgaggttccagagagaaaagaggaggccaggaaaaagaaaaaaaaaaggaaggtgctacttacgtgccgcaaatctctcataatcttcatttcattatccaccttttgatccaagaccccattcttcataaaccgccgcttgtcaagctccttggctgcatatacaacaccatgctgcttggtcgccagtttgtagacggtagcaaacgctcccttgccaatctgcccagttacattatacaaggaacctccggtccagtgcattccatagggatttcccaccgtccactggagcaccggctgcgaaggaggggcacggacctgctgctgtttagcattggcctcgtacttttggactcgctccaggtattcaaggaggttttgcgtgtactgtacggcgaagccatccctggatggtattctcacgacaaagcgcacttccgttttcactatattgtctgagactaccgtgataacagatccgttggtaagcatccgactggtctggtttaagggcttccagaggcggcagctatccactactgtgccattcgtggaggtgtcttggagcatcagaatgccgtccctgttcacgaagattcgaaaatgcatattcgaaatatgtttcgagtgttggtggggtgtgaggagcacatcacagcgtgcaggatggcggccaaaatagaaccctgccccgaggtttttaacagacgatgatagccgtagagcaatatcccgcgcagctgtgtccgagctgtcgtactccaagtcatcccgttgaagaatatgttgaggggctatgcgtgccgtcgcagcgacagcatcgtgggcggccggggaattgggatggaggatacagattatatccgacacatcttgttcgtcgagacccgagttatgggaacccagccgacgagggtcagagtatggctgagtggattcctgagttggctccattgctatgacactgagtaagagatacctgagaagacagagagagaccagacacctgggagtttgccgacaggcaggagtgttcttttatgtaaccaaacgtcttggtgtgtgtgtgagctatccaaagctgcgtgaagtttaggattggagatgccaatggacgtggtctggtgttgttaactatctccagggaaaccgcttgtaagcaacacaactaacaacgatgtcagtgagggcggcttgttcacatgcacatacgtgaactgcagtcaagttgacgcaaaatcaaccccctgtaatcaggccgttgccctctggaaaccacaataccttattccaaaaaccacctgctgtatctttgaacccaattccgcaggcagcagagctgagagaccagaacgatctgttccaggatggtcgatgtccacaacacgtaggtatggagatgcaccgccttgcaagactaagtctcttaacagactgtctaggcaatgttgtggtctggcagacatcaatgcctcccactgtctctgcgagagccgcagagctaattgagaacctccagctgccttagaggtcactcaattacccagccgccaacgattcacgctactgccgatagccccagcacaaataagcccgcctgttccggttcagttcaagtctggagttggcgaaaacgcggtgtttgtcggaactcgaaaagcgagtactgcggctcattgacgcgtgaaggcctggtcgacggcaaggaaacgatcccaggacggaacattcatcgctcgactgtctacaatcaccttcagatggtagtcagacccgtcctttgcatgctctgtgttttgcgaaatggaggaacaacgtacctttgtatactctccacacgggtcgtcggccaaacttccctgccagccatccaaacacgaacgcgacgacttggttcgtggtgcggacgacgatgctccggcaccagaataagaagtcgtggcacgcggctgtctggcagggccgtcgtccgagaaacgacagggcgagctatcctgatggaggggaccggttttatgctgcgaggcgaagcgtccccaggcatcaacatcgactggtccgtgcgagtccgcggaagcggttcctgaacctagcgacggcgcgccttgcctgatttgtcttactgcgggaacattccatggatggatatccgttccttgaattcttgtacacatcttaatgcgatcttctaggtctatatacatcagatatccaagcttctaaatcagcctcaagtctatttcgtcccatatggcttatttgtatcggtgctgcgctcaaacttcccgctgagagccgcatcgaacacttcccccagtcgacgtatcgcctcgtcggaaacctctgtgactcgtcagccttgtactgccttctgcctggaaggattttttgagtaagatcgcgaagcacttacggtagtgaatgacgagtctcccgcccagcagttgtaatcctttctcctttccaatttccgccaaatcatttgggcccaaccctgcggcttcaagatccagccataccatatttgtctcgactgggtacgtcagcttgccgccccgagaggtccacatctctgcgacctccttcgccttcacatgggtgttcttgagcttgcctccctgcccgttgggatccggcccgaacgtctcctccacggcaaccctggcagcagcagaaataataccagcttgacgagtaccacctccaatggacttgcggaaccaacgtgctcggtcaatgaactcctttgaaccaacgataatgctgccaattggtgcccctagacctttagagaaacatagactgacgctgtcgaagaggctggcgtagtccgataaactgcctgcacctgaaaccactgcttcccacaaccttgctccgtccaggtggaccttgatgttgttggcgtgtgcccattctacgattctccgagtctcactcaatggcatcaccatcccatcaagtgtgttctccaggctgatcaatttggtaggacagtagtggatgttggttccaggcacgaattttgcctgcagatcttccagcgtgaggtaacgcccattcttaggaacaacgccgtagactgttgctcctgtccacatactaaccccaccagcttcatattggattatgtgtgaccggtggtcgcagaggatcgaatacgggggctgtgttaggtgcgttcggatcgcaacctgattgcccatcgtaccagacatgaccagcaagccgctctcgtgcccggttcgttgtgctacgtaatcttggagggaattcgtggtagggtcttcgccaaacacgtcgtccagcagggtggtgtgggtgattgcctccagcatggataacgttggcttagtcatggtatcgcctaatcatgcgacggtcagcggtcccaggactggactcttcgtatgtcaattctgtgctcacttcgcagatcgaattcagccgcccctaacccatgccacggggtggtcttggtctggccattggcttcatcggcggagttctgaacgttcgacgccatggtgaaggttcgaaagggatttcttctcctgctagcaatagagagacttgacagcggtaatcggcgagcgattgagagagcacttttcatggagaatatttagacatccctcgattgagtcgtgattaattcagagtaattatgattagggcgcttactgcggggaacacgcaacttaatttggcaggacgtcggggcttccatgatcgataagaattctccgataggaaagacgcgcggatcgcgtcttagtcagccgcgcaagttgctgggcagcaactccacacgtgattgacgctgctgttgtcgctgccagttctgctgacgaccttcattttcgagcagtcagcagaaaagggccaggagacctaatgatgatggatctctcacacttgacacgcccatcaatcctgtgccagtgttcgcgctgctccagctcgctagccgcctgtgaaaatgagtgggcgaagctgtcgaacacgtactcgaccgttgcggggtggctcagcgttgacctgaataggattaatatatcttcggagaagaaacagatccctcagtcgtccgaactcagcttcgtacggggctgcattgtgcaggagattatgtgcaggctctgtcaccagaagctcggagctctcgcccacttggagaatgggtaggtcgcaaatcgccatctctacattcgcttggtttgctgaaccgcacatacagagtcaagatcttctggaaactgtctaaagtctcttttcgagagatcatatctatgagggagactcaaccggttttcaaggaaggcgcactacctactctcttcccacagcacagagctcccacggaacccgagtccacctcaagagctgacccgtcagccacctcagatcaatctgatagcgctcttcgcgctacctctgtccagcaacagatacagagtcagggagtgagcattaatcgaatctcaagctccgtcgacgagctgcacgataccatggccgaactaaaacaagcctttacagctttgcggatcgaattgaacgcacccggaaatcgtatacaggatatcgacaagatggacgggggtctggacatggtcaggactgtgctgaaagagcttaaagccaaagcagacgaaatcgaaaagctgagactggaaaacgagtcattgaagttgaagaacaagtatttggaggaacgaaatatggcagcatctccgcctatgccccatcgtttggacaatagagccatgtctgaagttcgcagtcctggtcttctaaatgagaatgggaagcgttcgtggcccggaacgctcacggataaccaccaccagcagatcgcggactcgttcgacgatgatggtgacaatgaaactgtgaaccacgtggcgttggaagagtctgcgctgcctcccgtcaaggttcccttgaagccagcagacgatactgctgctgccagttttcggcagctacagaatgaaatcgcgtcgtgggcgcagaacggagatggttccggttctgacctggtgacaggaggtcgaagtgaaaccggagagcctgccaataaacgcccacggctgagtactgcagagaatatcgagagccctggtagtgcaggaaaagagaaaaagaaaccagggaggcctaagggctggcgaaagtctacgggtcagacacagccatctgacgagccgcagacccccgtaccagcagtaatgttgtctgaacaggaggccgacgttagttccggcacacagagagaagaagctgtcgccaaccacgaagatgacaccgcagactctggagggcctcaaacacggagccgaggcagacgagcaagatccagggctccatccagggctgcatccaaggccccatccagagcgccatcagcctccccgatcgtcaccagatcagcccagaaagcccaagacaagaacactacaccacttaaagacatcgaagcaaacgaagcaaatgccgactctgtcgccacagctgaagcagcgttcacggttcaacctccggatatcccccagaattcaaattcatccgaaaaagagaacagtaatgagaatgcagtttcagcccccgatcaagtctcttcttccaacacgcgcaaatcccaagtcgccgccagagacgtcctggctaagatggcaatggagcgagaagaagcgatggcgactgacgggtagatggaaaaaaaatagatagatagataaaacagttcattgagaacatatcaactgtactatatcagatgtgtaaattagattcaggaaaaaagggaaaatgaatgtaatatgtaatatgcgaggattttttacttgctaagcacagtcttttcttgggttccatcgaatagagtaacttgttaaccaaggtatctaaataaagatctgttatactgcaccgtacgtatatatccttccttacctgaatttggaaactccagaaaagaaaggttgtgcgcggatacatcacggggggggggggggacgtcgaaagacacaatacacagagtaggaacgtgtatgaattttatagcagagttcttttttttaaattattattctatacagacagacagacagacagacagacagtgtagtacattggtatcatactatgctctaagccatgccatacagtatcatatcaccctgcaatcaataatgatgtctccacttcagcttgggtaataatacttacactcgccacggaataaacgataagagaaataaagaaataaaaacaaagaagaaacttctggtgtatcacataactcagttgtttacttcacgcacaagaacccacagccttccctcgccttttcgcacgctcgcttgagcgcttgctcctcccggtctgtccatttcacagtcaactcgtcccacggtttgcgggagttgaactcggctcggtagatcttgtgcattgcttgcagccggctgacttcgcgcgggtcgcccgtgccggagtacacgatgaagatcgtgcagggcggtaaggactcgtagatcttagcgatgtcggatacggtcttggacactgtcgccgcgagggtggatgtggaaggaggggtaaatgtcgatgcagatggatcagtgcttgccgatgcgttcaagatggtctcttccggcggaggaatgaacgtcgtcgattcgttggcgttgttcggatccggacgccgattgcaccagccacggagcacttcgagctctcgaagtcgggcccagacgaaatccacgccccctttcgggatgcggggatcggactcatcaccacagacggccctctcgatgcccttgacgacctcctcatcgttattgcatccgatggcaacggtcgcctgggatccataccctcgctcaggactgccccagtcaacgacagcgccggtacgcccttcggtcgttccagctttgacagaccggcttaatcgccgaaagatgctctcgttcgatgcgtcactcgtgccccagagctcgcctttctcgcatttttgtttgaccagctcgaggacagcgcgcgcatcctcgacggagtcatggcccgtctggcctttctggatctcctttcccaggtatttctgcgtcagccatttcagactgcatttgagaggcggtccgcgcgggtgagggtagatgatagctgtgtcaatgatgaacgggtgagtgagcttgagagcgttcaggtcggagttgagagaatgtccgactagtatagttcgaggagtcaggatctcaaggagtttcttttgaatatcagcaagggtcgtggtcacaggatccagtttctccttggtgataccggaaaatcgcgttagatagtcgatcaccggtcgttctggtttcacaagctcatccatcaccacctctccatcccaactcacgagactgatccgtgtcagctcagacttgccaccctcagtgatgcacatttcacagtccagcgccagcacgtcccgtccggcggtcatgctgccctgctggatctctgaatcgggaacgtcaccctctgagagcgactggacgtgggtgtcaacccatccctcttctgcagtttgacctaaccgctggcggattgctgcctctgcctgccgctctttttcggtttcaaaaaaagcaggatggagcacatagtcattctcacggagtgcctcaactgaactaataaaggtcgtgacgggtgtgcgtttcggcacccagttcttgtcgactctcggcggcttaggtcccttctgattctcgtgttccttggacttcggtaaggcagatagcagtattgcctgcagaggtgaatgaatcttgttgtatttcgagtcacccggtgctttcacaggccagatatggggaaacatgtccgccatgggctggagcggttcagggagattctctcgtgacagagggcgtgggttgaatcgcttagatttgtcggcagggggaagaccttgcttccatcgcgtgaaatcatccatattggattctgtttgattttctccggcagcttttgagtctgcagactctccctgatccgcactgactggcttgtcctctagtggtaccgagccatcaaacatgcccagctccaaaccagggaccattaagaccacgatcttgcggacgtggccggagtgctttatcgagatccattgtggcgcgataccatccgaaaagcaatagagcagcaatccctgaagatcagatatccgaatagacgactgcagacgaccctcgacataggtcaaactggggtatttgatcctctcgccatcagcacccctcctctttttcttcaccacaccgttcttctcaactgatttcaattcggcagaggcctctttctccgactcagccaccgcggtcgctgggcacgactctgggggagctgacgccggtgcagaggtattagaaccctgaatgagcgataaagtatgagctactccgaagccactcgcggtggcagtggagtctcttatcggattatcgtcatcagacctgtcagaggctctgcgcttgcgtttcttgccgaaaggcatgactggcagaagccagcaagtattctcgtagcttggtttctgtccgcagctagtcttctagatgagtgactgctgggcatccatttctacgactggatcagtcgttctgtagcacttgattttagtcgtgatgctaggcaaggataagaattcagtcgcggacggcaaactggatttcatatgtcacgtgacacgctacccgattggctgccggcccactctcccatacaggacggtacgagtaaatacccattaatacaccgcgcaagctgcaatgcagccaccaaccaacctaaattttgtttaaaaaaactggcttgattcatctgcgttccactggaacattaatcagatcttactggattgattagatgatgtttatcagctgaataccagagtaccatggtcaatatcgacaagcctcagcagtactgtactgcatccactgatgtattcaaggtactgccactctggatcgctgcattattgtctctccaataaatgatcactaataaaataatagtaatcacaagtccaagcttgcaaatgaatgattccccagctactaggaccgcatcgtcctatgcaagtggcaggaggacccttgagaatcgggccaccgcgatggcgtcaccgtcgtattaaagcttttccggactccggcatgcttcccgcagccgatactccgtacacggaggacaaaagctgcgaagatatcgtcgactccagcattggcttttctcccaattccacccggtattttgggccttcgggagatcagattcgtcgcgaaataattgtccttttggattttttgagcgagacaagactccataaaccagaacagagctaagacccgttaccttcggagctttttttcaccccctcgtcttcctctctcccccccgctatactgcttctccgccgccactatcaccatgtcgaccctcaacgagatcacctccgaagccgaattcaagtcgcacctggagtctctaccctcctctaccctcctcgttattaatttccataccccctgggcggcaccatgtgcgcagatgcgcaccgtcctttccacccttgccgcccagttccccgtcacgtccccgccgacggtctcgttcgtgagcatcaacgctgaagaacttcccgacatctcggaggaatacgatgtcacggccgtcccgtttgtggtcctgatccgcgacaagaaggtgctggagtccatcagcgggagcgacgcagccaaggtgcgtgacgccgtcgagcgtcatgccggtcgaagcggcgcggacgccgccagcggcaccaaggcctctattcccccggctctgaacgccgttcctcgagaaacgacgacctccggtgctgcgacggaggcgccagcaggagagacaacgaacggagctaccaccaccgccaccactactgctactgctcctgccgcagaaacccccgagcagagcaaggaggcgctcttcaagcgtctgtcggaactcgtcaaggccgcgcctgtcatgctcttcatgaagggcacgcccagcgcgccccagtgcggtttcagccggcaaatggttagcatcctccgcgagcacggcgtcaagtacggcttcttcaacatcctcgccgacgaggatgtccgacagggtctgaaggaatttgcggactggccgacgtacccgcaattgtgggttaagggtgaattggttggaggacttgatattgtacgtttacacacatatatatacccttgatgttcttttttttagtattcgtcaaactgactcaggttgatattcaggtcaaggaagaactcagctccaatcccgatttcctcaaggaatttaccgtccagtcctcggctgctgctgcctgaaccaataacctcatcatatgatggaaatgaaatgcttcctgcacgctagataccttacgacgattgtctcttgttttttactcacttatgaatgaccgcctgcgaagaacttttctgcctttcctccctgtccgttaaatatacttctcgagcgatagttatcgtaatttcacgcttccccccccttttactccgtacgttgtgtcacgactgtcgtctgtacgctaagctttgaatagaaaaaaaagaaaaggaaatcaggactcccagatcaatgaaatcattttctcattatttatacacaaaatccaagaaagtaggagtgaagaaggtcgttccttttttggggcgtgtggaacgaccagccagtcaaaatttgaatcgtactgtacagtacaatgctgactgtgtgagaaaatggaacacatgtgttgtataacgttgcacaggtggaatgtgattccttgaacaacaaagtggttacgtgggctgtcaacctgtctgctactggcctcatctcgcccgagaaaagaaatgaatgcaattttcacttaggaaagagaagatctgggagtatctaaagcaaagatatacattcgttttcgtacagtcatcgatatcgtcgtagacatccagtgtcagacatcagggtgtctgctgtgtctgctgcgtctgctctgtttgctgcgtctgctctgtttgctgcgcctgctccgtctgctgtgcctgctgtgcctgctccgtccgctccgtctgctctgtttgtgcctgctgtttgttgtgtcccaagaattcgacaagatttactctagaccactcagggtagtcacggtcgagcactctaaaccgcgacaagacggcatcttcatcaacgtatgcgccagccagccatcgctcaccggtcgtagtgttgaacgcccgccgggcgtgcgcgacacgccggttctcgaagatgacacactctcccgggttcagcttcagttcgaagatccgatgctctttttccatcgcactggcaaacgcggagagagctctctggtattcgcgaagccgccgagccaagaacggggagttagagaccttgaaaggggcctggaacggcggcgaatagttgacgtgctcaatgacccattgtgtttggccattctcttcgcgctttcgagcttcgacaactggccattgattgacatagatctgatcctcatgctcataatggtaattcagtttcaattccgtcagaagctccaagtagtgggtggggattttggtggcggcgttgaaggtatccacgaagagagattcacctccctcgcatgagttcttcaaacagtgcagcaactggtaacccggaggctccttcatgtacatcaaatccatgtggaaacccaggttctggttcgtgtaggccacattcttggcttcagggacactcttcacgtcccacgtcatgccgtagaaagtgttccgtagaggtcccatccgcgttgcgatcttctccaccatttctcgagagtcggggatgtccttgacaaagatgatgccgagcctttccagaacacccatggctcttgcaaatttggtgtcatcgttcatccactcatcgtacgtgatccagtgttgaagcctctccatgacgctccgggtccagaaaaaccggtgccttttatgtctggtcgagccgggggtccaggataagcgatggagggagtccgcatcgtaggtggagacgtgcgaccggtcaaatccgttgatatcagttttccattccaccacgagttctctctccttccactggatgctacgcgggcttatattccgaggaatatcgctgaaccggaaattgcgttgtttcgagtgtggatcgacacagcgcgggcaggtacaagcatcacgcagtttcagatagtcaagctttatgcgtacaggatttccgtgcttcgaagtctctggcacagtgacttcgaccagatgaggcccgatccggcggaaattgccagtggattctgaagtagataattagctaggagcagagtaggaaacgcgttgggctagaccacctgctgtgttcggggaatcggaaggcgttgcgttgttgctgtcctgattgccctcagattggggcgtggacactggttgcgagttgtcaacagcgtagccgcggcgaccagggagagttcgagggagagctctccgttgggagcgaagaagcagtcccagaggccgaaacattgtagtcattttcactaattgaccagcaattgtgatgagggaaggaaaatattatattgaaggacgaacggctttgcggagctctcgagctcctcgtgacacggaaatatccccttggagcgccgagtctgctgaaattagggcgcgtggaatctactagatatcattggtccaaatcttaccgctttggtaaaaagcggcaaaactaaaacacgtctgcaaatctggccaataaaaatgcgagcggtaagaagtctagccaattatcacaaatagaaaccgccgctaatttgaacaagaacgcagtgctcaagggaatattacgcggctattacacacccgataccaaatataatacacgacgtcaccaattgggtaggagacagtgtacggagtaaaccgatcggaaaacctctcactgtcgccccaacattccagctcccttctctttcgcaccactacgctcctttttttgccagtactgtccaatgcgataaatcaattcagctatcgacgcaaaagccaccatatgtatgtcggccgggggtgagcgcctaaaagatgaagtacgtctcagctaacatcagcgcttccaaaccagatgatttgacagagctgacgaactacttcccagggcacgaggacgcaggtcgtcatcgctggaggcatagctggccttgtctcgcggtatgatcattatccgtctcctctcccccttataattgtttcgcaattggcgatgctgacggaaagaatcgactcgcaacagtttctgcattgcgcctcttgacgtcgtgaagatccgactacagctgcagatccactcgctttcagatccgacctcgcaccatggaatcaaaggcccgatctataaggggacgctccggacaatgagggccatcgttcgggaggaaggtctcacggtatgtgttgttaggagttgctacttttcctgcccgcagggaggggaagcatggaatgttgactcgtcataatcgcaaaacgacaggcactttggaaagggaacatctccgccgaactcctttatgtctgctacggcggcgcccaattcgtgacctatcgcactacgacccaggccctttcgcgtctgccgcaccgtcttcctccgttggtggaatccttcgtctcgggcgcggtggcaggcggcatcgctacagctgccacatacccgttcgacctcctccgcactcgcttcgccgcccaggggaacgataggatctacgcgtccttgctgtcgtctatccgggacatcgccaagcaggaagggcccacgggtttcttccgcggctgctctgccgccgtcacccagatcgtgccctacatgggcctcttcttcgcgacgtacgagacgctccgcgtgcccctgggccagttcgacaatctcccattcggctcgggcgatgcagtcgcgggtatggtagccagcgtgctgtccaagaccggcgtcttcccgctggacctggtgcggaagcgtctgcaggttcaaggcccgacccgatcgcgatacgtgcacacgaacatccccgagtaccatggggtcttacggacgatagtgaccatcttacaagcacaaggaatgcgtgggctgtatcggggtctgaccgtcagtttagtcaaagcagcaccggccagcgccgtgactatgtggacgtatgagagggctctcaagatcttgcgggagttggaactcggcaaatagactggaatagactacggagtagacagggggatctgtggcgttagatagggttatttgcgttttttttttctattttgatatagagtcattatcccagcgatgggaacttattattaatttattattaatcctagcgaacaggaaggatcgaataataagacaatttatgctctttttccttttttttattaatcaaactcgactaataattgtctttgttcaatctgtcatcaaagctgtatttcgggtaaaaaaaagaaaccaacaatcgcttattgggtagtaacaaagggggttgtctcaagaagcacaaaagagagaagggtgagatatgtgcggaatatacgagtctgtcaagggaccagactccgaggggggacaatatgggacagagaaaactagacaggtggaatcacatcgattaagagtcggtcgtttcttagtattcagcaccctcctcgccctccgcctcgatactgtcgctggcaacctcctcatagtccttctcgagcgcagcaaggtcctcacgagcctcagagaactcaccctcctccataccttcgccgacgtaccagtgcacgaaagcgcgtttcgagtacatgaggtcgaacttgtggtccaggcggctccacgcctcggcaatggcggtggtgttggacagcatgctgacggagcggtcgacgggagcgagctcgccgccaggaacgcgcactggcttctggtagttgataccaagcttgaaaccagtcgggcaccactcgaccaggttgaaggaggccttggccttgacggaggcgacggcagcagtgcagtcacgaggaacgacgtctccacggtagaggagagccaccgccatgtacttgccgttgcgaggatcgcaaacaaccatctggttgttgggctcaaagcctagaagaacgagttaggtacgtcgcggagtatagggcattaggaatacgtacactggtaggtcaggtcgtgaaccttgaagctctcgtgcgagctccggttgctggaaacaactggggcgtaagagatcaaggggtagtggatacgcgggtacgggaccaggttggtctggaattcgttcagatcaacgttcagggcaccgtcaaatcggagactcgaggtgatcgagctgacgacctgggcgatcaggcggttcaggtgctcgtagctgggacgaggaatgtcgaggttgcgacggcagatgtcgtacacggcctcgttgtcaaccaggaaggtgcagtcagagttctcaatggtgctgtgcgtcgacaggacggcgttgtagggctcaacaaccgcggtcgaaacacgaggcgccgggtagacggagaactcgagcttggacttcttgccatagtcggtcgacagacgctcaagcaggagcgcaccgaaaccagaaccagtaccaccaccgaaggagtggaagatcaggaaaccttggagagaggagcagttgtctagaccttcattagcgaaaaattcctcatgacaggatgatgacttgacataccagcgacacgacgaatgcggtcaatgacagtgtcgaccagctcctttccgatggtgtagtgaccacgagcatctatatcccatcagcattgcttcagaccagtccttggcggtttgcttcatacagttgttggcagcatcctccttgccgctgatcagcatctccgggtggaagagctggcggtaggtaccggtgcggatctcatcaatgggctacggtagtcagcgacgtggttcctccttgctctttcggcgtccatgcacagtacgcaccgaggggtcgagatcgacgaagatagagcggggcacatatttgccgctggcagtctcggtgaagaaagtctcgtaggagccgggctcgccaatgtcggtggcatcggggtcgatacgaccgtctgccttgaggccgtgctccagcaagtacctatgatgagacgggctcagtatcaattcggaggaggcagcaaaagagaaaagcggtgaggacatacagctcccaggcgctgttacccagctgggtaccagcctggccgatgtgaaggtggcagacctgaacaaaacatgtcagctaatgggccagacgagggacagaagcagcgttgtggccgacggcctcagcggtcaggcagggcgcgcggtgtggtgggattcaggggaaaacaagaacgggcggggagtaaataaagagcgagccgggcgcgtacctcgcctctcatgttgaaggatcagcacaggacgttgggaagcagaaatcgaagcaagacagatgttgagagagcagcctgacacgaaatacaggcagacccgggcggacaggtggaaaggagggtggacactgggcgctgggagaaagaagaggtcgaagatcccacacgcggaggggacgaacgctggcggccgggcgtggtagcgcggtggagggcgctaacccgtctgggcgcgcgagttggcaggcccagctgctctttctgccgcagccaatcagcgcgcgcccccgtgcccctggaccagtgtgcagtcgctctgtccgcggatcgcctcaggcacgcccgactgcgccagagaagaaagtgaatgtgattaatatgcagatacgagtcaattctgcagtcttttattcttgttcttatttcctgctgcgtgtggtcgctgcttgaatggctgggctcccgagtgcgggggctttttgtgcgctgacaaagcaggtgccggtggattcgcgatggtccctgcggtgtgttggcgacaggcgaccagctaaccgcctcttcagactacctcaactagcaaccggtctacgaggcatggaccacatggcacggcccatcgagaggactggctttacaagacgactgcagcagatattcagtactattcacccattgcttgcatttgaagatgctagtcattcaagattgaatctagccgtatgggactgcataactgctgttgagtatctaatgcaaatccagtgctgatgtgaaatgtgaaataggacagttgtcctgctgctatctgcccgttgtagcttcttcccatctcttcgtttattcttcgcgatccagccagttaggaaactagatcacgtgcaggtgactcccatcatttgatttactatcttagcattcgaaacgactcgacattttttttctcgtcttttgactttcgaaattctcacttgtctcaagtttgtaatgagacatgcagagagagacagtcaaatgaatttctatctatactaggacggatttatctaatcgtaggtaggcattttcattagtttttttttctatctgataagtcacgttacctaggcatgtcttagcttgaccctatgctccaaagcccagcgagaaggcctgaaaagcctccacgggacgacgagtacgacgtattcacattctatttgctcaaatatattatttatcagttttagtgtacagtacatgctagcagggctccaaacaagagcatacgaaatttgtttggctctcatgagagaatccacaatccagaagatctgtgagattgcaacagcaaagaacggtagatagatcattgggtgtcgatatagaaaggcagagttattctgaagtggaagaacctggagaaaagagtgacgacccaaacttgatacaaattatatggaaccttttttctcttccttctttttaagtagagacagcaatattgacaaaaaaaagttacgatatgaaggtgacatagacaaatccaaaaactggtccatgaaggagaaatgggtcactacggcggtcgtgtcctccttaccgttatatatcgcctgtcttgtccttgacgaattttagagattgagagagagttggtccttttaatatttactctagtctatattgttagtcctctcttatttgggcctaccttatgaattttcagcaggtttatgccctacaatttggcaacttcttctacccagtataaaactttggatgtaggtttgattagaaaaaaagctaggataattatatcttgtttcctgagtggaatttgagggagtacttccctcagcatgagcgatggaatgttgagatgagagtttatggacaatttcgtctggtttgcatctttcattcctttctttattcatcagggcatctcttcgaagttcttcctgttcgatacagacaacgtaatactatacgataggagtctttctatcgaacttactctgctcttctcggatagggggggaaagtatttaaatagaattaattttatcagtgtttgaagaaatgcttcctttagatagccacaggggaatagattcggatatctgaaaagatctacgttaaatcgttgacttgattctcgaaatatagcttgcgaatgaatcgcatcgagagaaagtaatctcccaagaagatcatcccaagtgatatactggttgcacgattattttggcaaaattctaacaaataaatataataaatagagaagcaagcaaatatcgagttctatagataactaccaacacatttgaaaacttacaagaggtattgaactccgactgataatggcaagtaaacctgacgacatttagggggagcacacccgatcttgaaaattgcaactggcaaatatcttctccaacaggggatcatacaagtcaccgaactgggtggagatgtcggccgcgcagactttgatccatctaggaaatttgcgcccgaattttcgtttcaatgctgtcattctaatattgtcctcacccaatgttgtcctcacccattcctttgctgtgtcaccatcgtcacgaacggtactagcctcggtcagtatttcagcttcatattcagcatcatttttgttgtcatcctcttccttttcttcaatgttctgtccattcaggtaactgacgatcagataccaagccaatgctgatgcgaaactgttggatgcagacaaaccattcagccagagaagcctgatagtggaagtaggtttgcaggggcaattctctgaattgacgtcacaatgccatgagaggtccgcatagtatttatacgtggggaaccagatcatcgactccaggctgtcctcatttgtagtcaggcatgttgtgttggaagatggtgaatcgtctggatgatatagatggatatcagtttagcatgcccgctgagaattgatagataaacttcaaaaagtccttgccctcaataaatatagagagaatactaaagcataacctcctccacccctgtccctgcaacgtcagatcctctacccacctaatctcaattacatctcgtagtactgcgctgagcgacccctccactcagtaatgtttatccagggacgccaacgattcctcaatcagactattcaagcttgtaagagagagctgccaccgccgttcatttccataggctgcacatcgatgacctaggaagcccttacagctgaagggcgcagaccggacgaggaggaggacatagcagtaagattatttatttatgtctccgagctctgtatctgacgacaagacagaagaagaaagtgatgaaaatttctgacgatttggaagaggatgttgaagaatttcgcgacgcttacaggaatgcacctccccacgttcaataggctcgtgttcacgctcaccatgatcaagtttgtcataaatgagactgtggagaaaccatacccgcgagtcgataaggatagagttggtaggtaggtagacgggtagtcacgaatggggtatgttcttacccaaggtgtttcagatataggcataggaatgacagtatatgcctacataatcatttgagattttatcgtcgacaagccttacaagtctgcacttcgctaaactggtttggagagaaaatacctggtcgacgccggactctcttctctccaggtgggcttcctgcctatacatttgttttattcttgccataatggttcttgccatatcctttgctaatatgtagtacacttacctgatttctgcaattgctctgcttaagcggttcttcaccaaaaaattactttccattataataaagggaataatgttgaagcacattcaaaggatgcagcagatgccgtcttctactcatgtcgcttgtaatctcgtgtttgtcttgtctagttgagctttaggtactttgaataatggtatcatgtaacgctactggggtgaaatagggagaaatgtcctctgtatctctccacctccatgcggactgtactgagtagatatagatcagttggtgtatacagctcagccaaatgagtgcataacgagaaatgattggaagatgtttgcggcaaccgcgcgggtggcttgggcccgtggcgcgccttccaagattaacaaacagtattattataacggatcaggaaggagactgcatgactcctttttattttggaaggaacgacctctacggctttccctaacgggaacatccgcagagcactgaagacaagcaggacatcagacagtgacagacacttaggggagtcataattgccaaatcatggggtggcgtacacctacccaggtaggtacctgattataactttcaatccaatcagagaaatcaacacttgattgcttagtgaaggtttgtgcagaacgttattacataaacactctctcatagttatgccgtcggcccgtcggcaatggtcagggcaccccaagtcgagacggtaagatagggagcctggaatgcgggcggagcttgtggaggacagagtgattgggctacggaattgccgatggaggtcaaccagacgttgaaaaaaaaattctccatgcaaagggatccaacatccttcagagtttagacgtgcatcgacggtgcccgttcggtccaccgcctaggctcccaatcagccaatttttatctccttacgccctcggaatcggacagattcccccacttgggcctgtcttgaccaaagctccaggattatccttgccatgctgccgatcttaggtccgccttctggccactggcggcttggagacggggcccctccggagtcgagatctcagaagcgagcaacgatgcttgatgcgcagaatagccagcgtcgagctacttgaagtgctgctgcgcttgcactcctttccctctttttgtacccgtgcgatgttttcagtctttgtcactacttttcttttcttttgcctgtcaatctttagcagaacccgcagtccagcagcagactggccactttcgttatcgctacctgagagtcgcctatcgccgctactgtaccctcggagagtttgatcctacaattggacacggccggggaaatattcctattccaattgctgttccgttcagcgcgattctcatcctcatattattgagagggtgcttcactggcctggtgccagaatgtcgactccgatcgaagagatccccgagcccacgtatcacgtcgaacatcagggcccccgtcgctcgttggatgaagacagctctgtccacaatgacaccacggaggctggccgaaataccttgaatgtcgatacctcccacgccgatccatcagtgcggcctgaaccttccccatctcgagctcgcgaacatgcgacgcgactggaggacgacttggccgtgctggaagcggagcgcgtggtctccaactcgcagcggagcgaagagaagagcgagaaggcatctttgcataaatctcgctcccatcggtcggaaccggtcgatgagttcgatgcggctaccaatccgttgcacgagaaggcggccatctacaaaccgcctgagaatccaagcacgagcttggcaaagattgtgaagaaaatccacagctcgagctttctagtccgctacttcacttatattgtccctgtcgtcttgattctgctcattcccctcttgctcggggcgctgaagtataaggatgccagcgtgggcggggttcagttgttgtggttttcgatctggctggagatcgtttggttgacactgtgggcaggaagagtatgcgacacctccaaaagataataatttctgatcgatggactggctaactcgggataacatagattgtcgccaagtgcatcccggctccgttgggaataatcatgtcgttgttcaccaacaactcgaagaaatggcgggacttgggtaaacagctggagctgccggccacgctctttttctggtggctgggtgtggagatttcattcctgccaaccatgataaatcaccatgtcgatggcgatcgtacgacccgcgactgggaggtgacggtgaacaagatcattgtgtcggtgttcgtcgggactattctcaacctggtcgaaaagatcatcatccagttgattgccatcagcttccacacacgaacttatgcggaccgcatcgagatcaacaaatttcagatcggcagtttgaccaagctctacgcgtattcacggcagaagatttcgatgaaagacgaggaattcgaggaaaaaggaaatggccgccaatcggggacgaaaacccctcgccagtatgccactgccgccaccagggtcgccaggagcgctctgaacaaggtcggcgatgtggccggtgcggttgccggtgactttaccggaagaacgatcaccaagcgcaacgacccataccaggtagtccttaccctgctcaacacgacatctggcagccaggtcctggcgcgccgattgtaccgcactttcgtccgggatggcttcgatacagtcttttccggtgatctcaaggccgcgttcgacaacaacgaggaggcagatgcggcgttcgccatgttcgacaaggatatgaacggggacatctcgatggaagaactggaggctgtatgtgtggaaattgggcgcgagcggaaatcgattacggcgtctctgaaggacttggactcagtcgtttccaagctggatgatgtcctgttcttcatcgtcctcgtcatcaccatactggtcttcctctcgctgatctcgacatccgcggccggcgtcctgacgtcggcgggctccaccattcttgcgctctcctggctcttttcggcgacggcccaagagttcctccagtccgtcgtctttgtctttgtcaagcatccgttcgacgtcggagatcgggttaccatttatggaaacacaggtgataatctgacgggagatgactactacgtcaaagagatctcactcctgtacacggaattcaagaagatgcaaggccacgtcgttcaggccccgaacagctatctcaacacgctcttcattctcaaccagcgccgctcgggaggactggcggaagcggtaccgatcgtgatcaaattcgggaccaccatggaacagatcgaggcccttcgtcagcgactactcgaattcgtccggacggaaaagcgcgagtaccagcccaacattctcaccgagctgcgaaccgtcacagaagcgtactcgatcaccttgaacgtggtgttcttttacaaatccaactggcagaacgaggggctccggctgcaacgccgcaacaaattcatctgtatgctcatgctcaccatgatggagcttggtattgagggaccacgccggaacctccagggttcgcatgtcgatttcccgttccacgtcagctaccatggcatgccacccacttactcggctgccaccacggacaacagcgacctttctcgtccgcacactgtgccgactcctatccccgaagagcgcaccagcctgccggaaaactcagccgtcagcagtggcagcggccttggactccgcgcgtcgcactcgatcctgcgcaagggctccactgtcgccgcggctcgggcccgtggcgagtctgtctcccgacccaaccggcacgtcgacttctctctgggcatgtcgggcgttttatcggacgatatcatgggcgatgtgttcgatgacagaaaacagtcgcgactcgcggaagccgtgcagaacgccaaccgagaagccgcagagcgacggatgcgggaagaggagacagcatcgcgtgccagctcaacggcgtctccttgcgtgcgcggcggtctgacagacaggcgttcgtcgttcgagtcgcggacttccaatgcgacaggacgaccgagcttttcgtcttcgatccgtcagaaccgattcttggggcggttaggctcgcagtacagggcgcggaacccagagcaggaagatcaggacctggaacaaggacagcagcaaccacaagaccgcatcgatggacgaggcggaaatccacaagccactgttaatgacgacaatgacgtatctcgactttgatagtgagcgatctaacgtctggcggccatctgagttatatatcttgctctgttattgcccgaataatagcacataccatgcatctacacctgccatctgatcttacctgatctatctactgtcgtcaatgttgtactgtacatacatactgtacatacatacccctaatcgcgtcgatttgtcagcctggcctgacctgactgaagcatatgggtggcattttgtttatttcgtccatttatttacgtgcatctaattggcatatatccatctgtagattttggattacttttttttcccccttttctcattattcaaaagtggttgattcaatcgatcattatgtatgcatgtatgcattgcatatactactactatactagtattactgtacatacatgttcaggattgtatgcacagagtacatgcggaatgtacatactgtactgtatgtacaagaaaaaatatgtctgcatatgcaggtaacaacagtactatacatagacatagacatatgtactgtacagtaaggctaactaaataactaaataactaaccatctcctcctccttcccttccattctttcttttctttccctcctttcattttttgatttcaattgaattcatctcatctcttcacatccatccattcattcacattcattcattgaaattgaagaaaatcgatacttatttgacaatgcttgcttgctttcttgcttgctcaatccacattgcattgcattgacatgcatacatacccttaggttaaaaaaaagtcgagtcaaatgacgagaagaaaacctgaacacctcgcccttctcgccatatacacgccttcaaaggataaaaggagaaaaacagagaagtatcaacaaaaacaggtagatatgcggggaaacaacaacgcccaaccaaaaagaaaaaaaaaaaggaataacaaaagcagataatgaatcaaatgccagacagaagacagaactccggctaataatcgtcaagatgaacaaaaaaaaagaagttgagacattcaaagcggaaaggtcttctttttttcccctctgccttctttcttctcttccgtttttcgcctttcgcctttcgctctgactctcggcccaaacaaacaaaaaaaaaacaaaagcttggaacttagcagcagcagtaatgctagtagtagtggcagtagtaatggtactaagtaatgatataataatgacaataatcgaggtagaaatagaagagtcaaagttggagtcaaagtcagtcggagttggagaaagagaagaaaagagacaggtccgtctagccaggaatcaatcaattaatcaatcaattaatcggatcgatcaatggctactatcatcatgaacttgatgaaaaaaaaaatcattgtcaagacaagacaagagaagaactaaacgtttgtctgtttgttcgttcgtttcgtttcgtttcgtttcttgctcttctccaatgactatgatccttccttccatccagcataactttacaagacatgcctatcgcatcctccaaggaaagattgtcgaccggtactctgctgcgcgctcgcgtcccttttccatcgggcgcggcgtcgactcatcgtccatctcggcggaagacgatggcgtggtagaggtcggcgcgggcttgggagtggcgtccgcgtcaccattctcgtcttcagccgccagcaggtcgttctcgttctcgttctcggcacgctctgtaatgccgggagaataatcggcctcgctaggttgcgcggcagacggttcgactacgtcttcgactggaccgctatctttaggagacggtgtcgtgatttcaggagtcttcaatgcagggacaacagtctgctgaggatcggtcggagactgaatatccgtctcctggtccaaaggcaaaggagccggacactccggatgttcaagctgaggctgggttgattcaggtacctccaatggtccaggtccgtcatcatcttgtttcgtctcgccgggagaaatgttctcgtccgggatctgaagcgcttccagcttttgttcaatctcggaagtgcttgtaccgccagtctctcccgcgttgtcagcagtcacgctttggtctgtcgactccttctctttcttgagcagctcctcgctgccgctgacgacacttccgcgactattagtcctcatcatttcagtgcccagcttcgaactcgaccgaggccccttcgtcgtctgcgaactacggattcgcagttggaggctcccgagctcctcatcttcatcgtccccagactccgcacattcgtgcagcctcttctccagggactctcgcttggtacggatggcttcgctggaccgttgcttgcggggtgtgaccagtccaggaacgccagaagtaggcggcgccgaaactgtgtgctgtaactgaggcaaagtgatgggactaggattggctttcggatcagcaaccccagccgcggccgctgcgtcttctgagatccccaatcctcctggactagtgccccattcgtcagtatggcgactgatgatgacaggaacctcctccggcttgacagagtccacatcggtaaagtaactgcttccgatggaatcttcacgactggagccccgataagagctggacggcatctgcgggaagcctgatgatgtcgaactgggactgtcctcagcacgtccaagtgcttggcgcaccaccgatggaggtatcgacagaggctgcggcggaatgtcgtccttcgacggaggcttccattgacagaatttgcccagcgcgtcgatcagcttggtcagagtgggaggcttctcaatgagcgcatcgaaatagtgagtctccgggaggtccttgagataaccagtgacggcgatgatgggagtgtgcttgttggcacttcttgtctcccgcaccatccgtgccacgtccgccccgttgatctgagggagtctgaattcggtcatgataatatcaaactggacctcactcaaagcgtaccggatcgcctcggacccgttgaccgcagttatcgtacgacaacggagcttctcgaagagtcgttccatcacgatcctcgaaactggatgatcttcacagatgagaacatcaagcggccggaagaacgggccttctggcatattgatttgagaaagccgtcgagaactttgacgccgcctctgcaccttgagaagggcctttgtgcggggatcttcgttgtcagaagacgacggagatatgtcgaacaactggcttcggcgtttatggtgacctggaatgtatggctccttcacactctgcacgtcactctcctgagagccaatggtctgggacctcgcacgcgttgtgaccccgccctgacgattgccagaggctgttttgctgtccggggactgtgccggaactctagcgggcttatttggagatggtgccgaggatgcgagtttgatgctcgtcgtcatgcgagaaggatcaccagctttttccgtgggtataggtccactagactggtgagactgtgtcgaagaagagccagacgtctttctccgttcgtgattctgcccagtgctgaattgcaccagcaacggcgacgatggctgcgatggccgactcggggatgaggagtttgcctgactcaggctggatggcgaagccggtcgattgttgcccttgttttgagaaagggtgcgttgaagcggtataggaagaagaggactgccctccagagaaggccctgagctcgtcggcggcgttggcgcagctgccgacgtgatggctctttgttgcgcttgcatagcttcctgtcgcaaccgctggataacgtccttgttggctttttccaacatggggagattcttgaagttgaaatttccaaaatcatcagctaagacgggctcgctcagccgtctgctgcgtgaatcccggacatgggggggtatgtgcaatggcatcagcccccgcttgagggaattcacctgagaacggaccttggagagcgcgtcatgtggacggtctggatagtcccctgtcgacatcggatattgaggggacaactgatcctcaagatcttcctgaaacgattgaagcgttgcgccacgagcatcgaaatattcggtatcttcaggattctcagtgttcggcacgaactgcgcctggtcttccagcaaggtatcccagttgatgtccgcaaaccatggatggctgcggatctcagctcctccattgggaaatttctcctcagcattggcgccaaggcgtttttcaggatcgatcgtcatcagcttgttcatcaagtcgatcgcttcgggagaaaccatctcttcagcaccttcaggccagttgattcgtctgttcaagatattatcgaagacctcatctggggtgtcggcgttgaaaggaggatatccgtacagaaattcaaataggatacaacccaatgaccaccaatcgctcatctcgtcctgtcccgagccattgatcgtctcaggagcaagataatcaggcgtaccaacgaatcgtctgttattgtcttcggggtcgaacaacgccatcggaggaggcagcatcgactgctggggcggggtgccgtattgagtggaagagtgactgatagtctgatgtaatggcacaaggtggggagagtcgcctccttcgcttggggcttcctcttctgccgtactgctccgcggcgccagggacaagggtgctggggtttcgcctccttcgttgagggagaaattccgaaacatggcattcaaagtatcgctacccccactgtcactccggtacccagatgcgcgtctcgagttttcacggccggaagtgggctggttgagactgaagtacgaaggttggttgtagctccccgcagtgtccggggtgatgataggggtcgagctaggtgactgaccgccctgaagatcgaaggatgcagagcgcgacgaggcgagggacgtgcccttgggaaactggccctgcttgagaagatcaggggcaggttcgttgggattcttcaacacgcgtttctgacgaccaacgagacccatccgagacagtccaaagtcggtcagtttgaggtgtcctttctgatcgatgaggagattatcgggcttgagatcacgatggactattcctcggctgtggagatgttcaacccccagaacaacttcggcgatgtatttctttgcccaatcttcgggaagtcctccaaggaccttgacgagagaagcgcagtccccgccgttcaaatattccatcaccagataaagatagtctttgctggagaacgtccaatacaacttggcgacgaagtcgctctccccctgccacatcatgatggctcgttccgccttcacatttgtcacctgattctttgcaaccatatccgccttcttgagaaccttgatggcgaaatactccccggtaatcttctttttcgcgagataaacactcccaaaagcccccttgctgattggcttgatgacttcgaaatccttgatggaagtgggtgcggggcggggctgaggctggctgaccgaggacaaacgcggtgaaagtggcggcttagcaacatcggaggatgttgcggacgactgtcggcgatgatgatagtggaggtggtgatgctgcggtaagctatgggccgcaccctcgtttgaagactgtaatggagacatgctcggagagggcagagtctctccgctaggaaggcgaggcttagacagccgcagaggggatggaggagccggcccccgagcaggggacggttggcgtcgcggagagctcgacaagcccggtaggatgagactctttcgcttctttcctctggaactggctttgcgcgagagacccttatcggaggagggagaatctgtccgcatcccccccgtgaagaccgacgagggcacgctgctgctatcactgttctcacccgcatcgctctcagcaagcagggaaccccgttttgatggctgagacgtgcccagaagaccagtgacgcttttatgggaccgtggcgtgggacactccattgggctggccgatcgagtcgacacggcgacggacgaaccccctcgcggtgattgagacattgacgagggatctgatgaagttcgtgccaccccttcaatcgacgtatcttgagatgcaggagccgccgtaatctgagaggagtcctgctgttccccctcgacatcctcctccagcaaatcttcatccccataggacgaggacgaatcgctgagctcgccagcggcaatgcgttcagccttgctcaaagcagcatcgatgcattcctctaccataactgtgtactcaacgcggagccgttccgcatattcgacaattctgcgatgtcgaatgaccgcgtcgactttggcttttgcgagctgctccgtatctgcagataaggcggccaggccctgctcttggtcgagagtattgctgctgggtgactgccactgcagaacctgagagatgcgggactccgactgcggcgacaaggttcgaagatcctcgccgttgtccgcacgagtctcctttagcgccggggtgctgatctccaacgccgtgtcgcagagatccagaatcaactcgacgatacgggcgaggggtcggcgcacggcgaaggagcgacctcgtccgtgtccaaagccggaggtcgacggctccctggatcgaggcggcgtagccggagacgaactggcggtagaagtcggtcccgatgatgcaggagacggtccgatgggcaggcctttgtattccggctggggcaatgaagggtcagattggggtcgcccctgacgggcttcaagagcgtccaggaccttgacgatcgcatgccgatgctcctcgaggttctcctgtgcgatctggacgtccatttccgcccgatgttcctgcaaacaaagctccgaatgcttctcgaaccaccagggagtgatctggcgctcgcagatgcgacagaggactggagcaggcatctgctgcttcgccgcgataggatcgctggcccccatctccgccagtttggtcaagtgattcgccaggacctctgctccgactcccaaggattccacaagtaaaggaggaagatcaatagtcacttcctttggcggtgttgacggccgcagcatccacattgtctaatcaaaccagtgtcagcaagcccagtccctgaaaatcaagtaatccaatgcaacttacatgaccttctccatcggctgaacgatcatacaccatgatcccttgggcttccatgttgaggatatcggcctgtctgtcttggctatcctcctctggcggtgcctgtttctcattttcattctcgccgattgggtgatcactgtcgcgcggatgttgctctggaggatatttcagcaccgagtcggggcccatgcggactgcaaagcggataaagcggctgtgcgagccgtcctctttcatcgactcaacggcatcgtggaaggcggtcttgttggtgagcaggacgtcggagatggcctttccttcgacggactctggggtagagcccacgacctgcttccaggatgggctcacccacttgatgcggccgtcgagacccaggtcaaggatgacattcaacgtctgctccgcagcctcccgaaggtcgtcacgttctgcccgcatgtcatcgctgaaggagcgttccatcgacaccctccgggattctgaaccacgggcctcctgcctcaaggccgtgacagccggaggggcgaggaatcggggcggttcaccgtcattggccgccatgcttgtggtgccttgtagaggcgagggtaaattcgacgccaggtgccctcgcaggaggacacctgatcacaggtcgccaggaggttggaggagattcgtagagcctgagaggtaccaagcaaagccggaccgtctgccaggcagagcgggtgcccgtgagcaggttatggctttgccggcagcatcagcaggccatggcgggggaaggatgagagggggccgttcaagtcgacaatctcactgcacagcggagaggcaaagcgagggccacacgccctcaacgaaagacggtgctcgcgttgtcaaggcaggagaatttggacgtgacggggaatcggtgggtagagagctgtcgagtcgaggacgtacgtcagtatcccgacgtgactcgtcgctggccgggcggtggggagcggaggcgaggtggagcgctcactaagcaggcgagaaggcgaacgaggcgagcccacctcagggacaattaatgctcagggcaaaggcatgcacggggaggatagcagcatggacagcaagattgtcgacagaaataaagaagagcgcgcgacgagggacggagcgggacgagggttggagatccgactcacgagactagcggaggccacgggctcgacggccggttagtgaggacaagaacgacacgagccaatgacgctgggactggagcgtatctgatgaagagagactcagatcagctacggagcctacggtctctacgacgacaactgtcatgcctggaacagcattgacggccgtgcgtttgctggtcggaaggctgggtccgatgacataattcagcgcatccagcagatcaacgagatggagctggacagtagttcctacagcagttgcgtctccagtgcaagccagccgtggtgcacgttgagaactcgaggctatcccttgcctcaggctgaatcttccattattactgatacagccagccatcatgtgatcctggccacggcggaggaattgctccggcgcgcggcatccgttatatcagcactcgtgtccagcatcatgctccagcggtgtagatgcgcagtcgatgtcgtacaaatagcttttttcccctggtcgacaggctaactacgtgtacggagtacggactataaggttgtggagtccagggcagtggtgtgcgtgcctggtcgtcagtctcagcgacaaactcggtcaatagtaccgaacaagaaccgcagccctgtatttatttccccactaacttaagaccagcgttctagcagcaaatcatcgctgaagtcctgacgcagtcgatgcagatggcctgattctgctgtcgtatccctccatccttggcccgtttttctggtttcccctcctcctcccccttcatacctgctgggattccgcataagcggtagcccaacaacgccagtagagcgactctccagccaaagagatcgcagacgtgccgttctggccttacgccaccggcttgtcttggacagccgggctctatattaagtttcgctcttctcgaagcatcttctcgattgacccctgtcatggaggaattcgaagagcagcacgagaccggtttacctcagcactttgacttttctagcctaacacgagggcgaggaatttttcacttttactgttcttttttggttaaaaagaaatcatttcacatacggagcacgtaatagagatagttaaaatgccagcctcgtgtgatctttgtgccctcccaccatcagtttacctgccaaccggcaaaagtcagggaactaggtagtttactactgaatttcttttttttttatatgacaaccaaccacaaacgacaattctcgtaattaactcatttcatccattaatattattcattcatggagggcgtgctatctaccccattagttagttgtacgccagtttagttggcaattaactctcccaaattgcggggaaaatatagttcagatttgaaccggccacccacgcgcgcacacacacagcacatcctttatcctctctctctctctctgtcattctgcagatgcggtaggactggtatgtggccaaatcccgccttcaatcctggtacttaaccctattccatccttgcactctcctgcagccgttgtatgtgcatctcccagtccagtaggaaggaagtatgtacagtacagtatgtatatagtagcgagtattaattcctacgtacatagcaggcaagagatcaccgtttctttcttggcctacctacatgcataaccgacttgccagctgacatggagaacactagactcctagcatgtactgtatgtcctgtacaagaagagatttgcatcccatgacctttccgctcctcgagccgtctcttgtctttttaactctcgagtagtagccaactacacgccagtaactatattcttaatacgttctagcccagccagctagctagctgcatatgtagccacccagccatcatccatcccgctagactagggttgagtgtactgtatgtatgtacgttccccctcttggtcaggattgaaatttcccgggaaaataatttcctctctttttctttcgtctatccatttcagcggggtgaaaaaaaagaaaaaaaagagagaacgtgggggttagttatgcacatgtagtattagtatactgattgccattgtccttcttatctttacctggaaaagtagttccatacgatactgtacctatagtagctacctgcataggtatatgtacccaaggtaatagcagggttaattaacctccatctttaccacctgacacctgacttcccaagttcccccttgtctatgtagtactgataataattaatagcttaataaacgttaaataacaaccaataaataaggtttttatactgctctactgctcgatttgtctattcgtacgtcatggctgtctgcgtgtcttcgtatatggtaattcgtttgttaggataattaaagcaattgattaattgcatcaatgatataatatcaaactataacttgttatctatgtcctggaccatggatgtatgtgctgtacatacatacatactatctctggagatgaagtgtctggtctggttaaatcggagcgttcgtttgagatttctatcagtaaattcatgaatagaactatcagaggaattctattctatccctgcaaacaccggcgaaagtcactcatgacagaaaaagacaacgtctaatatggaaacgacagaaaccctcgatgcctctcatgcaatgaagaatgctaaggaaaatattaacaatgtctatacttcttatgctgtgatggacaactcctgtcaagccgccttggagttgtccttctcctcgttcttccttactcgcaggtcagccagacacggagcgtagaacaacttcccggaaacgacgcccttcaccgttccgacggacacgacgatccacagtaatgtgacagcgacggaaaagatctgtgcaaatgtcagctgcgacagacactcattaagttacttaggtaagatgattgatagacgcaccgttccaagcaccaggaagaatcgcgacggcaactccctccccaactggcaggtactcgtcgcgaaaacgcccagcgggaacgtaaatccccaccagccaatgttgaagggaaagttcctgctgtaggcgatcgatgcagacgcaaagaacagccacaccagcccgaaggcccacatgatgagagcgaccagcatgccaaccgcgtagaagatcgaacctgcattacctgacagagtctgtgtctgggggaatatggcctgcgcggcggctccaagcttcatgagtctgaatacccaatacgacatgtcagatttatttgggtctggtggggggcttgactttgacttacccaaaaccaccttgaccaagagggcccagtggcaggaagacgctcacgatcatcgccttcggaggcaatttgtgcagcgtcagccgctggaagtagatgaccatcaccatcaatgccattgggatgccgatcccccacaggatgtagctgacgatgatggtccacagcgcatgctgcgggtcggtgagcatgtcggcgacaatggctcccgaggcggcggcaacgacgcagctgacgacgggcagcagccagacggctgtcatggaagacagctgcacctcgggcatgtgcatcattctgcaggtgtcagcgaggggttaaatggagaaaatatcacttcgcaagactttcgttacgttaaggacagcatacagaagagcaggaagagacagcgccgtcatgaccgatatcacagcatcgaagatccacatcccccaggcgaaattcctcgtccactcgccccaggccggaacacacacaaagcagaacatgttgatgatagtcgcgaagcccatgggaaaggtgccgataaacatcgactggaccggatggcggatcatggccatgaagatgtcgggatagaggatgtaccgcatcgcagtaatgacgcaggccgctgcaaagagaaccacattcagaacaaagatgatgattgagatccagtacagccatgaaccattatagggcaaggtgttcagcagaatggacacgattcctgtgcccatggtcaccgaaaaccatctagtttggtcaagttagccagttatcttcttgcaaggatgaatccactgcgagaaaaaaaaagggtattattggcgtgtacatacgatggcgtaaaatgtcgaacaatccgtctccagccaacatcgtgctgtgtgggctcagccgtagaggaatcattgtcttcttccatagtattttccgacatgttatcagctcaatggcagaatcaatagatagacagaagaaaatagaaaaaatctctgctatttccttcctttcttttgtcccgcaatgaaggactggctgacgatgaccaaagaatttctcctcccttgttttttatatgtagatcgtcgtcgatactcctccatgagcatgcagtctgacatcagatatataatccatgcttctcaatccacccacgtgcattattgtcatatgtgtctatgtcatcgacgcctcttcttcttgtcttcttgaatcggccgggaagagtatgactcgatttgcctgtagtaggttcttttggctttggcaccttaccatttccgtcctgccggccgagtgagatttatgtttgtaccgtactgtacaccattaggtaagcagaaagttatcctatcctgcagtatagaagactggtatgtagataagaatattaattctgattctttatttttttattttataaaaaaaaataagagcgacgtaagtcaatgttgtctttgacgaacttgaatgtatatttgtttcatggattacattgcggagtacgttaagtactccgtaggtaccttacctgtaacctccatgactcaggtcacgctattttctttcggccggctcctctctcctccgcaagccggtgatagccgggaatcctttgtggagtactccgtaatcaatttctctgcatcaggtatgctacataggtagcccattatgaaggctataagcagggcgcaaagtgaggaagaaggtatgtagcaagactttatgaacgattcatctgctaggttcaaggtatgtactgtacagacaaggtacgcgagtgagttgtttatctaaatcctgcgtcgaaagaccttaatcagccaaggcagtcagtcagaacagaactatccaggttgctgtgccaaagaccctatgagtcggcaggctgagtgtaatctctcgtctttgctatcggttgattaacattattctaacataagctatcaaattatgtactgtactgaatataaatgctggaaaggaatcatggtaatatctacagaaacactcttcccctgtccttcctgcctttttttttcccctctactgctccttcttctccttcgtggcagccttgttcgccaacacataacctaccgccctcgcgagaccttcttcgacagatacgacaggcttatatcccagcctctccttggctttggcgcatgagtaataccgcgtcatgcacgaatagcgcaccatccgtctcgtcagacgcggcgtcttgccaagcaatgcgaaaataccctccgtgattgcgcccacgacggtcaagaaaccctccgaaatgacaaaggcatctttcggctcgatgatcttgtctgtcagcgcccatgccgctcgcgtcatgtcccaaaagtacactggcgagtcgttggtgacgttgaacgcctcgccgtcaacgcgctcatagtccaggggtgcaccctgtccgttctcgaagcgcgcatacgttgccagaagacgctccgccgctagcatgtgagcataggagacattgcccacatatgtaaagtcgaagagattgttgttgtcgccgacttgcatgcgaagcgtagtgcgagacgctttggaggagtgttctaggatcttgaacgtaaacgtcgtgtctctttcgccgtatatgcccgctggacggatcgcgcacgtcaacattgaaccggaagcggcacgattgtatttgaggacaagctcttccgcatcagcctgttgggaaagcaaattctgtcagtatcacaacctcgtcccagtgccacttgcgagggaacccaccttcgtctcggaatagtattccttctgcaacgggccccggacataaggccattgctcgttcacgttgatcaaatcactgtgcgtatcgtgcaccacagagctcgagctcgtgtagacgaaggccttgcacttcccgccccagtcacccttggcaccactggcgacgtcaagcagagtctgcgtcccctccacgttgaccttgtggatcaatggcttgttctcatccagcataagagacgccgtatgaatcaccacctccggcttcaccttccggaagacctccagcatcgattccgctgacgtgatatcgccctcgtagtactcggcgccgggcaggcggttgtgggtcgtacgcagatcgaccacggcgaccttggctgcatacttgggataccgcccagtcagacgagggtggtcgaatcgggaatctccttcaatcctgggaagagcagcgctgggatcgttttccgtggggaagttgagcagctggtcgacgatattcgaacccaggaagccgcagccgccgaccaccaggacagtgcccagctcaatcgtacgttgtttcggaggcattggagggatgtggagggcttctctatggcccctgtaaagaaaggatcaaggaagccttgcgtaaacgtagttgtgagagactgagctggacaaggtggctactccaaaaattcaaaggggtccgtcgttgcggagacgatcgcggagctggagcttagtccggtgggccaatgcggtagctaaatgtccgccatatgaaaacgatgaatacctgaagtacatccaaagccaactgcagtccatcatctccattctactccgtacagcatgacttaatctttattgttgcattggtcttgaaattttcctaaatcatacgatgcagttgggcgtgctatcagcactcgaaagtaacagaacagagccgagtcatcatctcagttgcgttcaagagtgtttacaattgctatcaagcaaacaattttaacaaattactgagtcccatgcaggttgatttgatggtgcaatcaaaccagtcaaatagtcgttagctgatattcattgttcacaatttgggctaactagttagttattaaaatccctgtctggtggcgattaattacgtcccgaaaagtcccacgactccagctacgttgccgaacgagaatgcaaagtcaaattgaaatcgtcgtcctttgcccgcaaactccgagacgccctcccaagtacgatctcagcgccagagaagaagagtgctagtgataaaaaaaaggcatgagcaaatcgtgcaaattctgagtgacacactagaggaataattagaacgtattaaggctagaatcgctcatggaaccttttgagatgaaaagcttttccgattgcatggaagactggctgctatgcgggatgcacaacatgcctatgcctctctgtatgtgtgtcagacacttggatgctgtaccaagctgtcgaggataggtcactcactctgtacttctctccaccgactttctcagtgcgcggtagtatttcttcttctcctcggctgagccccagaagagctttgacgcctccagattcaccgtcgttctcggatcgtagggcggagattcttcttccagggcctccacaatcgcctcgatatgatgcttcatctcttccgtgcgcctgggcaagtagcaaagcactccgtccttagaaacgcggtgatggaagagaggagtttcgacgaacacgcgcggctgctcgtccgggaagcggggactgaggtgaatcttaatcttgaagattccgccgtcgaggtgtgtcatgggccgtccaaaataggtcatcttccagacgaatgggttatcgtccaagagcgtcaagtcaatagcgaaggccttctggcgttgaagatcttcaacaacctgctcatactgacgttgtaggttgaccgcaattctggattcacgtttcttcgcctccagacctttaactgcccagttcttcgtctcgttaaggatggcttctttgataaaacgtatccgcctcttcaattccgggtagtcgaagaccccagccatggcattgtctccaccctcaaaagacatttgctggaacttctcttgcggtttgactttctgcgcagcggtttcgatcgtctgcatgtaggattcgtaataccacaagaaacgcctcttgcgaagatcactaaaaggctcaaacgccgccttttcgtcctcaaaacatgtctcttcgtcatccgtgtcactcgcattcgtaggagggaggagggttccatccaattgaatcccgagagaatcttcaagaggctggatcaccgcaatccgtagagtttcgtgttgaatctagtgtccatcagcagccaaaccatagattctggccggtcattgtacactaccttcgcgatgtagtgagccatcatgatcttgtcctcgggagacttggcatcttcgtaacccggttcattttcgtaggggttggaggacatcagactctggatggagatcaagatcgactccaggccttgggccgatgaccattcttcgcccctctcgccgcgccatgtgcttgaggactatttagcaatttcacgttgctgtaatgatgtcaagtgcattacccgagaattgatctgtgacgaaggaaccagtcagcgcttgtctcaaagcttatggcatgtaaggtgcatgtgcttacaggcaaacttttccatttgcgtaaatgttaggattgaatcgacatcttcccccgtttgttgttatcgctcgcacatttggcgggcttcccgggtaatcttggacggtgaccatcattagttacgactttcagccatggaagtgttagaataccaacctttgggaaatctgatcaagaactgcgacgaccgctgcttgtcagtatgtcatcaggagagggcaggcgatcctggcagacgtacctcgaagaagccaaactcatagggagtcccaggaggaccaacaatcaacgccttgacgttgcggatatcggattcctgataagccactgcaatagcttctcaagcaatgagcaaacttgctgtcaacgggaagccaggtatctttgcagatccacctacagagatctgttccttgctggatctggcggatctcctatattaccccaccaccccgcccgttgtcagttagtccatgtagttaggtgaaacgcgagatcaccaatgtgacaaataagaaaacatacacgtgtgatacgtagaatggcatggtccgacatattgataacaggagcaggtgctcgaagttgacctcttgcttcgctgttgtgccttggactatgcaataaatctcagatcagtatctcagaggtcagacagtgtgttcataataaaacaattcaagcagaacgaggcagaacaagggagaaacggggaccctttggcgcctgatgtagccttgcgctaagactaagagtcccggaagttgagtgtggaaagtgagttgaaaagtaggtgcaagtaagacttgcatgcaggcagccagcactcagtcactgctctgcgttacacaggcgacagacaaaaagaggtttctaatcgtcataatctgtcactgaggcttcatcgtaagggtgaatgagcgatctgtttccaggttccagtttctacattcagcgcctgcctcatccaggtcaaccatggatggtcctgccaagaccagtgacagccgcccctccaagagtgcctgttctgctctgccctcttgtagaaactgttgatcttttttctgatgggttagatcacacatatttattatgtcgtctgatccaatcgactgtataattccttctagccagtatacctaggtgctctccacctgctgtgttttttattagtaaacagagatgataatggatgctcattatttaccctgggatacagaataactagtttggaagtacaggcagaatatgatccatccccatttccatgattccgacaaggagctgttaagaacatgcctctctgactgagctctcttttattttatgccaaatcgctgttttgatgatttcaaggctttagcaagcccgatcatcgatgctaaactggcagtagcgaaggcggtcagcgagtcacatgattgtcctagcggcggccagcaaccgcagggaacagaggcattgggttgataagggggcatcgcctgcatcccgtcactggaacaacaaacactcgctgtacctcccgcacttgctgccgttttcactgatttcttcccagaaattgttggcgcattttgtttcttccaaaaagcgtgtgctggcggaggaggcgctctctggaactgcgcattggcatgaataacgggaatggttgagatcgtgttggccagtgtgctccgccgcctgttgtgtctcaccttgggctctaacttagggatctggggagcagcctcccccatcacaactttgcatatccccccgcctttgatccgcgtcgcatttccgtcgacaatcttgtcctcctgttgaccatcgatcgaaccagctcacctcctctgtttttgtccccgacactccttggcgccgatcacccgaggactgcttcacagctactgtacatggcgtgagacagaactgaacaacgcaaagctcatgatattgggaagaaacactggagaatctgtctctggtttatggcttgaacctagagatacacgtatgtgctaacgtctccccgacgcttgcggtatacctctgtctacccataatcgtgcgtgcaaccaacctcgactacgacaatagacgggcacatcgtgctttgaaaactgtccctggcgcctttcacggctgaggatttggaaaaggtttcaggatctgtaccacgtgcggtggacttgcctgtcatgcctccggaccgtgctttacccgacatcctcatgcctgggaacggaggtgcaaacagccctcggaactgggcgaaccaggcaggctctcagtcacaatctcccatctcccccttggatgaaagtgtccctctcgactcgccgctgtcgagaactggaaatgcgccgtggaatggaggagcacagtcttctcgtgacgatgtccagcaacaagacgatccgaaaagacaagataccggcaatgatccccaggaccatgatcaggcggatcagcgcgatcgatcgaacccacgagagagacctcgaccacctgcacggtccaataccaagtctccggggagcacgactcgcatttgcaagaagtgtggcgagactctcaccggccagtttgttcgagctctgggaggtacctatcatctggagtgtttcaagtgcaatgtaagtcggccctgatttcttccatgtctgtcttttgctcagacttctgaccgaacaatgattggcaggactgcggcgagatcgtggcatccaaattcttccctgtcgacgccgaagacggaagtggacagtaccccttgtgcgagactgattatttcagacgcttgaatctcctttgtcacgcatgcggcggcgccctgcgtggctcttacatcaccgctttggatcgcaagtaccacatcgaacatttcacctgctccgtctgtccgaccgtctttggtgcccaagactcttattatgagcacgaagggaatgtctattgtcactatcactactcgactcagttcgcccagagatgcaatggctgtcataccgccatcctcaagcagttcgtcgagatcttccgcaacggtcacaaccagcattggcaccccgaatgctatatgattcataagttctggaatgtccgactcgcgccagcaggccagccgcttgagaggccggaggttggtatcgatgcgactgacgaagagcgcgaacgcgtccggcaggaggaagatatgatggaagagaaggtctacaagatctggagtattctctcctcattcgaagagtcatcggccgcgtgcatttcggacatgcttctgcatgtgagcaatggtgcctatgtggacggcgtacaggttgcaaaaaagttcatttcacacgtcgaaatcctctttacggctattgacatgttgtccactatgtttaaagagcaagggatcaagggttcgtactcctctagccatgtggtatctttgctgtgctaattgagatactagatctgtcttatggacgcgaagccaagcttctatgcaagaaaatcgtggccttcttctctttgctttcgaaaactcaggagaccggtgtcaggaagttgggcgtcactcaggagttgctctcgttggtaactgggctcgcccactatctcaagttgctgatccggatcggccttcagggtgcgctgaagctggagcgcgagaggaatacctctgatggactgtacaggtttcttgaccatctcggggaccatattgaggaactgaaggccgctgaggaggaatcaaccgatctaatgaccggagtcgaaaacctggcagatcagtattctgactgctgtgcagcatgtaaagagccaattgatgatgcatgcgtgattttgggcgacaggagatggcacatcaaaccaccacaccttgtttgtggggtgtgtcagaaggatctcacagtcgatctccctgatggcctgtggagtgagaaggatgaccgtccattctgtcgcaactgcgccattcaaaagggccgtgtcccagctgcacagggaggcttcgcatatgtcagcaaactccaacagtatgtgtttctcctcaaggtcgctctggcaaggttgctttcggttctacgatccagtgggaccctctctcaaacgtcaggtatgtcatttagccgcccttcttcctccgtgagatgttaactcactattcaaactgcagatgatcccaacgtcaacgagcacgaagcgaacgaagggaatcgggtctcgaccaccggtgaattggtgtcgtcgtcccctcagaagaccaacacacgttcgagagcgtacactagctcgcatgctaccgaggagtcttcttctctggaacagaccgttggtgaaatgcggagactacgttcgatccgaaatgaacggactttgtcaaccacctacaagaaagcccgtgcgtcgagaatcatcgacggccccgagggaagtagtgtgcggcctggctcgtccggtggcgatgcggttgacgctcgaaaccaacgtttccagatagtggaagagaaggacgcaaatggcgacaccgtgaattcattgacattcggtaatcaagacgcgcttaccttggacgatatccctaggattgtggccgccgagcaagcgaaagaacagcgtcccaatgcctatagacatgccggtactaatctcgttggttccggtcctccagcaaaatacagtccggggcatcgccgggaggtgtcagggcccccagcggagccgcctccgcctgacaatgcaccaacgaagactaagaagtatttctcggaactgtcagcgttggagtatttcattgttcgacacgtcgccgttctttcaatggagccacttgttgagggccacttcagtctcgaggaacttctctctttgattgagtcccgaaaacctaccatttggaacatcttcggacgcgcatttaataaggaagggaagcggccaggaaagaagaagggcgtctttggagtcagcctcgactacctggtcgagaaggagggcgcagaatctacgcatggcgtgggacctggcgcacttcgtgtccctgcccttattgacgatgccgtgtcggcgatgcgacaaatggacatgtccgttgagggtgtcttccggaagaatggcaatattcggcgcctaaaggatttggctgatatgattgataataagtacgaccaagtcgacttgagcaaggagagtcccgtccagattgctgcgttactgaagaagttccttcgagagatgcctgatccccttttgaccttcaaactgcaccgccttttcgtgatttctcagagtaagtttcctttctcagatatcagaagacgggtagttgctaacaaacttgacagaaattcccgatccagagaaacagaaacggctgttgcatttaacgtgttgtctcctaccaaaggctcatcgtgacaccatggaggtcctcttcgcattccttaattggacgtcgtcattttcccacgtcgacgaggagtctggaagcaagatggacatccacaatcttgccactgtcatgactccgaacatcctttaccccaacacgaagaacagcagtatggacgaaagcttcctagccatcgaggcggttagttcactaatcacgtataatgacacaatgtgcgaggtaagctcaagtcataaattaccatttgagattccgttccagagattaattccgtcccaggttcctgaagatcttcagtcgatcctcaatgatgccagtttcttcaaagacaacgccgacattaccacgaaagagattcttaagcggtatggtgactttggcaagggaaaccttgcgcaaaagatcttgcaaagcggagagatgtccggcagcactggttctactcgcagtaacaatgctgcagcgaccgcacgaattgagacggatccttcccaggctgcggcttggcagatgcagagttcggtccgtcatgttcaagccccggggagttctcagcagagtacggaacatgctcagcagcaaacccagcagggcgactatcgtgaccgaagcgccagtgctgccagccagcaagcgatgggtcggccttctcagtctgatgcgcagcagcaactcccatacagacctcatgctggcacaggacctatgggggtcgctggctgatttagcgcgatcaccagtcactggattaaggtgttttgtttcttgcacaggtgcaattattatggtcatatgcgttcctcggtgcgataggaaggtaaaaccaaaaaaggggggggtagaggtccggtataatcaaactgtgcacagggctagcggattcgttggacgtgactttgttttatttttttttctttctgacacgaaagtcttctcagatggtgcgttggtcggtttctacggattgatgatgagcttgcttttgcttctgtcagccatgtttgttcagtcacgtcacgttttgctattcgattccctgccatagcctggcttttgtttctatggacgtcgacgtcttatgttctgcactgcattcttctcgagcggatcgaaagatcacatgcatggtattcatctacaattcagcgtaaagcctctatgacatccattcatcctgcgaatactcactcgatctgctccctctccctcatcattttctttttctccgctattcctttttctcaggtcggcgtcggcttcttacccatctagccatccttcgattcgattctatttgctcaaagctgtggcgacggcatctcataattttatgcatattccaaaaaacagacgcttcttttctttcctccgcagcccatgcttgcatctatcctggaaaggtccaaatgtccaagtaggacaccggacccggtttggcgcattcgcattaagtcgagcattcgtgtcgtttcatttcgtttcgttttcttttcttttctttcctttttttttcctgttatttgcattcccataccaagtcttcgtggagtattcttttccttctccctctccccctttttttttcgacggagtttttttttttctttgttatttgtcttccttcactcatgaaaatgcacgtgccttgcggttcaattcaattcaatccaattaaattcattcaacttcaaagcctgattgatactagcagccaggaccattccaagtatttgttttttttttacacccctttttttttctaattcccattaataaaataataccatacataccataccgcagcatatcaattattgttaccattattactaccatcattattggtattaagtaaataacaattataatcaaaatgggggccaccaccaatatcaaaaatatatataaaaaaggagagggaagattacttaacacgcacacacacacatacctcctcttttcgttctttttgtatctttgtagaaatgtacatgatgtagacggaataattaataagattcacttgatttcttcaatgttagtcgtaattagtagctactgtcgaagataactgatcaaccaacattaactagggggggaaaaatatacctagttaggtatgcatgtagaacttctagttgacgagagttcgttgatgagaccagaccaggccgatacatacaattgctttttttaaaaaaaaagttacacaaatatatatatatatatatacctacctacctccagtactctacctacttacctatccctgtctagggggttaaggaaggttgatcagattcccatctcctccttccttcacagggacattatgtatgcactatacatacatacgtagctcctacgtgcaataggcaggtaagtagggtagctgagagccactgtgctgcgggggcagtttattcaggtggttgacaataataataaataatattgagcctttttttgcccatgtctccaaaatcgccagctatagctataacaaacagtatataataataacagttagataggatccttccttcctatgcatactctgatctggatggatctgtggcaagaaaacaagcaaaaaaccaaacccaaacccgaacccgaaacgccggataccatactaatacactcctctttcaaggttatatgcccaaaacaatgcgacgcaatgcgctgcgacgacgcctctatcctctctggaatagaaatgtaggtccaatctaaccctcactcaaaacagcccaaacttttccaagtcgaacaaacgccctaataatatcaatatcgaacagccttgagagtgcctcgccctttgaaacttttcaggtccaaatctctcttttctatcaaagtttcccaactgttgtaagcttgattatcgcaatatcatcacatcgcaagccacaacactgcaagggatctatacacgtctccgcaatacccttccactcgctgaaggtggatcgccaccagcggcaactttcctcccagcagcggctgtctttttggcagtcgcagcagcggttgggccttggcttcgtgccactgtggttttcttggctgttgtggaggccggagttgcggctccagtccgcttcgcagcagcgccagctcgtgtcgacttgacgatcgttgttcccgaagaaatattagacgatatggtgctcgtgctggtagttcgatcttgctgacgtgttgctggccgcgctggggatttggcacttgcagctgttggcttcgtggttgtcttggctgtagtcttcttagtctgggatgttgctttcgctttcttcgtcgtcgcaaccggagatgctttcttggcttccgatgccatatcctttgtggttcgcgctctagcactctcgatcatagccttcaatgggctggaaggcttcaggggtgatgctggccgggacaagtatgacgctggttgctgtggtttactcggcgaagtaatcagcggagattgatgataggttcgcgagttggaagactttggagagagaatcttggcctcagcgccacggaggacctgagacacagcacgcgattgaccagcggcaacgttcggattaccccgtttcttcgggttatcgagcggaatatggacatctgcaggtactggagcgttctccttgtctgaaaacaggccatcatcactagcgaccggttagcatgttgctggaacgatgagaatacaagtcgtacctggcgcgcttgacacgacgggattgtgccttgaccgctgtaggagctgcagcagacgcgctttgaccttccacatccctagatatcgtggtgggagcagcactcttggcagccttcggaggaagggccggtttcttcatgggttctgctgcctcctccggtcgtgccgtggcagcgtacttctccaacaattcacccatggtgaccttccgcagagcaacaggaacacggttcacgcgccgttcaatccgcgctcgaaggtcctgtgcctggagagcgtattgtgcacgcagtttgcgagcccgttccgtaactggcttgcgtcagcaatgctcaatcaagggaggccgtcgcgtccattgtagcgggcagcatgatcttactctccaattgtaggttgtcaatgagagcctgcttctggctccgagtgatcttcaatttcttcctggcagggctgcctgtaggcgttgcagccggatcgtcattgtgggagccgcgttcaggctcgggcgacttgcgtttccccggcaagagagaagccattgtgcccgaaaatggcaaaacagataaatctcagacgagtatccaattccgccgctcaaaaaacctgtagcttcttcgaaaatatggtggaaagcgatagttcggcgaaagtcgcgtggcaagcaatgtgcgcggcgcgttgaggatgctgagatgctgcagcgaagtcgagacagcgagtgtaaacaattggaagcggagaggcggctaagaatagttagtgcgggttgcgggcggtgtgccgagctcgaaccacgcctctgcctaagctccgctatcagcatcattcatcatcggcgctgtcccagtccaccagcctcatccgcccgcagcgcatccttattctcctgcttgcagtccctgcctccaagtacctgctccggccttcttgcttcctacggaagacatcctggtcttttctcagtttcccttccacagagctcactggctctgatcgaccgccaagatggtgctggaggcgactatgatcatgtccgttcgctcaccctcatcagattacaaacaggagctgacagcatctgcagtgtggacaacagtgaaccgagcagaaatggcgactatacgtaagttgtgtgtgctatgttcggagaaaagagccgtcgttaacctctcccagttcaacgcgatggcaagcgcagatcgacgcagtgagcgttatccatagcgctaagatgcgagcgcacccccagtccgccgtcggtctaatgagcatgggtggaaacggacctgaggtcctctcgacgtttacatcggactttggtaagatcctgtcggggctgcaccgaacgaagatccatggcacctcgcatcttgcctcgagcatacaggtcgccggtgtaagtgtttacacgtcttcaagttaagtaggctctgcgctgacagtatttgggtcagttggctttgaagcatcgctcggagaagtcccagagacaacgaatcatcgtgtttacatgcgctcccattgccgaagacgaaaagacgcttgtcaagctggccaagaagatgaagaaaaacaacgtatcaatcgatgttgtcgcctttggcgatctggattctgacacgaccaagaagttggaggcgtttaggaattgttggctatagtgtcagcatttcgaacatggagagttatttggaaggagcaaacacactatccgagtgatctctgatcacaaaaatcttacctacttcacgacaactaaagtgttgacgcgaaggcaggcaagatgggccgagatacttgcaaactatgactttgtcattgagcattgcaagggaaaagaaaatggacaagcagatgcactgagccgacgagcggactatgaagaaggaattcgaaaacctgaaccagcactgcttcggaagactgaagacggaaccatgatgtataatcatcaggttgctagtcttgaagcaacaagcgaactcttgaaatcatcatttatcgacaaactcattgaggaaacaaaaagggacaccatgattcaacaaatgttagagaactctgcagacaacgacaaactgactcaaggtgatgatgggattgtctatctccacaaccttatctatgtgccacaaagcctacggcaagaagtgatcaaaatgcaccacgatctaccggctcatgggcacatgggaaccgagaaaacaacggaacagatctcgaggaattactactttccgaacatgagacgaacagtggaacgatacatcaaaaattgtgacagctgtcaaagaaacaaaccagcacgacatcaaccatatggaaagcttcaaccactagaagtaccaaaaaggccatgggaatggattactatcgacttcatcacgcagttaccaaaatcgcttgacataacgactaagaagcactatgatgctatcatggtgatcgttgacagattgacaaaatacgcatacttcaaaccagtggaatcaacagcgaatgcgacacaaatagcagcagtattactgcaaacggtcacagcaaatcatggaatgccacgattcatcacaaccgacagagataagatattcatttcgaaactatggcgttcatggatggatctgataggggtagagcatagactcagcacctcataccatccacagaccgacgggcaaaccgaacgaaccaaccagacaatcgaacaatatcttcgacattatcttgattatgatcaggataattgggttgatattttaccaattgcgcaatttgcatacaacaacgcaatcagttcgacgactggagaaacaccattctacgcgaactacggatatcaccctcaattggcctatgaacctctgaaacagcaagaagaagcaccactggcaaaagaacatgcggacaatctacgacacatgcatacaatgatgcaacgagatattgaattcgtgaacctcagaatggcaacatactacgataagaagagatctgagggaccagatctcaaggagggggagaaagtttaccttctacgacgaaacatcaaaactaaacgaccgagcgcaaaattggatcacattcgactaggaccatttaccattgaaaagaaaaccggaccagtgaactacaaactcaaactaccagaaagcatgaagatacatccaatttttcatatctcattgctggaacgagcaccagaaaacgccaaggaacccggaaatatcgaactggacgacaccacagaagaagaatacgaggtcgaaaagattctggcaaggaaaagagtcaacggtcaaatctattacttagtcaagtggaagggatacgatacttcagaaaacacatgggaaccaattaagaacttgacgaattgccgtgagaagattcgagaattccaccgacagcaacaagctcagatggattcggagaccagcgaagaatctcatttatctgactctcagtcagattaggaacttcggacaacgctgcgagattttgttcactctcgataggagaatcgggaggaatgccgagaggatcttcttcatctaattgttccatcaccaaggaatcatgttccaacatcttagaaccccgttctcgcaaaagacgtttctgcttcaataaacggacttgtttggcatgaaggcgagccaactcctcagaaattttcagaaggtctgaatcgatcttttgttcggctttcaaaagatcattccactctttatcgctatgaaatcgtttttcgcatttccgaccacgacgagtgcaagcagcgcaatttcgactctttgaatccattatacacgattgatttttacgttcacaataatgacaaggaggatcaactggaaaaccatgatgatgaattaagtcagcttgacgaagacgttccttatagcgatcacgaggcatggtgaaaacagcatcatcactcaccaagaagagaaacgaggaccacggagatgataagggtgaagcttctatttatgtctttgaggacaaagaccttggagagagggagtgatgttatgaaccaaccggagacaacgctgtccaacacagcgatgcaggatgaaacaattaccccgcgaggcagaaactacacaaagacataccatcggagatcacgtgacatggtataagtataccatccagatataccaagaaaggtataccaaaaggccttggaggacctcgatggtataccactgtaaggtatacaaatggtacactcagaaggagatataaaaggagggaaaattccagccatgtatctagtctttccttactcgcgctcaatttcaccttgttattccgttactaagatacttactctgggggtcagtaagacttcttactactagtggtatacttcggtatagctctagtaggcgttgcctctgacctagtcgttgttgttcttgattatcgaagcaccctatcgtgtgtccctgtgactgccgcttacgagttcaccacgttgacgactgtacccggccaaatcatctataatggagctaagattcaaatgctcgacttgcccggtatcatccagggagccaaggatggcaaaggtcgtggaagacaggtcatcgcggtcgctagaacttgccatctcattttcattgttttggacgttaacaagccattgacggacaagaggattatcgaaaacgaactagaagggttcggcatcagaatcaacaagcagccgccaaatatcgtcttcaagaaaaaggacaaaggaggcattaatatcacgagcactgtccccttgacccatatcgaccatgatgtgagttatggcgcagtctggaatcacaagcatcctttagctgacctcctattaggagatcaaagccgtcatgagcgagtataagatttcctctgctgatatttctattcgctgtgacgctactatcgacgatctgattgacgtgcttgaggccaagaaccgagtctatatacccgtcatttatgtgttgaacaagatagattccatttccattgaggaactggatctattgtaccggattcccaatgcctgtccaatcagtgcggagcacggctggaacctggacgaactgctggaacagatgtgggagagactgaatctccgacggatatacaccaaaccgaagggccagcaaccagactacacggccccagttgttctcaaagccaatgcgtgcacggtcgaagattttgtaagccaactctcgaacgaattacctcttgttggagttttggctgttaacacctttgtctagtgcaatgctattcacaagtcgatcgtcgaccagtttaaggtcgccattgtttacggccgctcagtcaagcaccagcctcaacgagttgggctgagccacgagcttgctgacgaggatatcggtcagtattccctttctgcccagcttggatgtgggtactgaccatcttgtcacagtcacgatcattaagcgataagagctgcctttttggcaataatcagcccgggcgtgtgcaccccgcactgcagggcatgaacgccatgacgataaattctcggtggcaggtggtcgctgcgtccgggtattgcctttaagaacgttgcattcttaggggcacgttccctgtcagccgccacacaaagtttaaaagtgggcggcaaggatgggggcaacgcttcaaaaagacggcagctgcagccctaattcaaatccgccctttcctcctttggagaagagttttaagcgaaactggccggtacatttgcaaatcaacatggttatcgttgttgctaggcacctgctctctttcgcctgtaggcttacagttcgacccgtcgaaatgaggacgttgggatgtcaatcggcatatgttctgtagctacagagtcaccgaacggaatggctattcaacacagtatcttgcgttgtttgccactctgaaccatcactgtttcatctctgtgaacgatatattcaattcactgcaagtacagggtcttaggctgacagcgccgaattcgaccttttttcttctattttttttttacccttctacctctccttcctccttttcgccttgaagacaaggatacccgtcagattagaaataatgacaacttatttttaatcaagaccttcttctggtgaaggtactcgagcatcatcaagcgccagggtggtgagtgccgatcgaatgagcgagggtgtgggcgcaaaaatgaggcaacaaaaccggggagaaaaagaaacttttactactgctgttagggttatccactggagatgccactactctttcttttatccggacagatcttttgtcagatttgcccaatcgccaacacgacgaggatcaggggcacacacgcaccacttgtttaaagcacagcgttgcggtatagggaaggtgcggtctcgacctctgccgatatcgaatcccaggtcaaccaagggttgccggcatttccgggtttgcatattccatggcagaaccctatgtattatggagtagggtttcttaatagtaacatcaagtactggcataactacctaggtattaatattgaatctacctaattcgaaccccaaccccaaattgactaggtacatcgatcggactgacagactgctaaagtccgtcatctgccagagggctccacctgggcgctgtgtacggagtagtgtgcccactgctgtcttcttgtacgccgtagactatctccccgtatggaagcagtgcgtgcattgccttggagttgggccgcagcgacatctggtcatgcggatcagggtccatccggtgcccgtgtcagaagttgccgcccatcgctctttcgcttcgtagattgaatgtacgcgcaactgtcttgggcttggagatctggtcggtctacatacccgatatcgcatctccatgtcacaccaacaagtcgacaccctgtccctgcacgggtcatggttaccccccagcggtagcgtcttgcaacagagacgagactggctgacggatggacgacaccgatctgctttcttgccggattggatctcatcggctccttcctactttgtacgccagtccgtatcctttctgcccgatcacggcgactgtcgtattggacaggcaggaattgaacgacatccgagtactcaaaagcactctcagcgttaccttgtggctcgttgattttgccggccatgggcgaattacgatggacagcagtggtgagcacgagatggttccatctcctagtagctacagaggctcggtgccaacttaagaataccacctgcctaggtacctcaaagagtaaaggacgcaaggactaacatcggttaatccggcgcatcgatcatcaatcgacaataataggatatagaccgtccattagtcatctcgtcgcggcgcctgctagctcccgcactgcatttcatgacgtcgcgccgcccagtgaagtgcccaacccgggttacaaaagccatctcgtcgacttcctgactcggagactccatcatcgcgaagcctacaggccctggagtcttggacagaatctgcacgacggccaatgcgggctcggccgaaactcccgactccacaccctccacatcccctccgaccgtggcgaacagaggacggactgctcagtgcgtcgctggccactgatcttctgtcctgttgatctcgcaagccaggcggttatggaggcggctagtctcgcctgtggcctaactagttccaggctaccgacttaccgtacaattcgcccagcctgttcaggacggcctctgaggcccgcgcctagcgtgaggtcagcctccgtggcatctgtcacacgcccaggtgccatcggggcaggaacatgacggccaattcttgtcctgttcctgacaggctccagagcttttatcaacaccatgtgctacaccgtttggtctattattggcgatggatcaacgtcgcacgatgggctggctttggaattcaccgtgctgcccgcctcattctgagcgagccgcgactcgcgagcgaaatgacgacacgcaaagcgactggctcttctcggccgtgaagaaattgagcgacggggaaggagacacatgggtatgaaataatacggaggactcgagagtacggggtgctccgtgctgcgtaatcacgattgttgccatcttgggccgtggcaggcagccgacctgggctgaaacttggaggaagattttctcattttgcatgacggtggagatcggttcgcaaatcatcgcccacaaggctatacttttcgggccgcccttgacggcttaacgatggccatgaaccaactcttagggtggaggctatcagcacgaggtccgttccgcccgtagcgactcccgagcttgttatccactcaacggccgcaacgagatcccttcgatcgtcctgaggaaccggctgtttaggagccttggccgtatctgttttctccaaggatttgcggcacatgagtggacgctacttcggatgccctagcctaggcatggtggatcgcaagtgggccgtacaatggacatcgagggaccgggccttagctgcctcggagctaattagagagcagggcagatggacagacctcccctccttctcctcttctcctcattgtttctgcttgaagacggcttgataggatgcctgccaaatcgacttgttccgaccatgtatcggtacttgtaatatatcctccactcagtggtctttgcttgtctttttccgatctcgtgtccattggacggagtacccgtacatacatcttgcatttcgtcgatcccttgcccttgactgactggtcctttcattgacaaattttttcgaatatccctgggtgacgtcttagaacggaggaccagaatggggcacaagacccttcactaatatggaggacggaggaatgggggtttcggcgcttagccggtaataattaatagcgatctgatcgcgtattcagtcggttgactcagttcagtgatcttggctatagcgacgaatcaacaaaggaggttagaaaaaaagccttaaaaagtattcagacaagaaaaaaaaaaaagaaaaaaacgtgactgtcactagatgcaggatttctctgctgacctcgtgcgtcgggttttgagagatcagtgccctccaatcaccatgctcgccatgggtgttttttttttcgttagtcaggattacaggatcccgctttcgtcttcatgccagatccaggatcaacgcgatcgctctctgttcttattattattagactgtagtcactagttggttacttctcgagtctccaccaccttgccaaagctgccgccttgtaatctcagcagtccaccggcggtggtcgggcgatctaccatcgcccgtgcccggggatcgtgcctctgctgtcgaactcgtgcgaactatcattcgctcccgtagtgggcggcaacctcgcaatatcaccctccagagaactgctattcgacccgtgatgaactaaaccatagccaactaacccccatcatcctttctggtcaggaaggcaggcggagggaaatgatgattgcctgatgagccggttgctgtttggtaatgtatttgccaggtacagcgttgtacgcctcgtttccggcctggtaattcggtctggttagtcttgagcgcccccggtccaatatctcgcaagccagccaaccagccagcgttccccccaccattttctcgctgtctgtccaatcaagaggccctgtcaagtctttgtttttactcgcctacagtcgtttttcttctttctcccagggcccgtttctttaccgctatcgctatgtcgggcttctggttcttcctccgtagcatggcctccggaccttcgtgctctaccctggctgtagaagagttgcctcttcggttcatggtcgctatcttcccacctgatcgctgtagttggtagttcggtccctaggctcccctaccttagttcccctgctatatgttgacagccctgcccggtcctctccatgccctacccgcctaccctgcagccatcgaatatcctcgcccctccaccctcctgtccttccccaacctgcatgagcgacaacgctgcgccaaagcttctttctggctagctgctgcatatattgacgattgcctctcgggttcggccctaagcgcgtccggacccgagtctgtcgatctatctatctccttgggcctggatactcggtactgctgttgacagtcgttcctgattgacaatgcatcatcatttcaaccgggatcgaacctaaccagatcgcattcctgtccttttcgatcttgtctgaagggggtctgcgcgtgtgctggttgttgctgctccttgggtgcttgctctctgttctgtgcccggtttccgcagtgggaaggagccatcgtcagctgagcgggacgagcccgagtctcgtgtatcgagggaagcagcgccttctaccatggatacggatgcacagcatgcacaggagaacgagtacggaagttccccgtgggtcgacatgggaggcttcgaacctcctccgctccacagtcccccaatgccggacttcaacactttcagttatggacctgcgccagtcatgccgatggagcccgcatacagcatgtcgattcctccgccttacacggcgctgcatttatcaatgccatcctatccctggcccagcatgttgacgactcagtccaatttctcggacagcaccttgtcccctgcgccagcaccgaccctctccatcccacggccagcaccgatacgccctcttcgcactgggtcagcatcgtctggacctactccccgcaggactttgactgacgaggaccgtcgacgaatgtgtctctatcatgaagagaataagactgcgaaacaaaccgatattggaggtaaagtttcccttttctggcgcctcatggacatacaaagatgctgacggctatcttcgcagcgctgttcggtgtggaacgaaggtagagcttgcccaatcgcccctttgaaataaaaagaatacatctggttcttttcatttaattctgacacttcatgaaaagcactgtttccaaggttcttcgccagaaagagaaatatctgaatatggacgatgggagtcgatctcccatcaagagaagcaaaggaagggtcccagatatcgaaaaggctctggcaaattgggccaggaattaccagcgtcagggctacactctgacggatgctatgatcagggagaaagcacatttctttgcgaccacttgcggcagtcctgatggcaaggagaaggttctcagcgcgagctggctcgagaaattcaaacagaagtacaacctgatgggatacaagtccaggaagaattcagtcgataccaccgccagcgagacagaaagccccgtacaaattaaaaccagttcaagcacacagacatcaaacggggtgtcccccatctcccccagcggattgaccacaccgtcccccttgtccccatcacagaaccaagagggtatgaaaaaagagccgtcagacgggcacggggatctgaccaaagactaccaacacacgcactctcagagcactacctcccttgagacggcgccgtctctttcggccagtgtggcaagcccaacatcgccattggtctcagagagtccctataccccttcaggtcgctcccgtctcccttcgatcagttccagtgcaagccgaccccgcagccaaaccttccctagttcagcccctggtgatgggactgcagaccaatccacacctagaaatatcctcgaacaatcgttgtcgacttcagtgttcgactccccgatagaagaggggccagaggccgcaccatcctctgatgacgccaacgtcatcaagcggaatcgaagcaacccggagatcaagaccacgtcaatgcagccgcctcccttaccgaaatcaagtaccgtctctccaactaccagccccgtatcgccaacccaagacgaggcacgtcgtgctctggaactcgtctggaattatttccagaaccagccctccggactcgccccgcaagagtgcatgacgatcgggaaattgatggaaaagctcgacattgcacggagtcaagcgaacgtggtaccttcacggcttcagcgaatcgaggagcatgcagacagtcctcgggtgaataaaaaacgaagcattcactcactaacctgagcaataacccacgtctctaattcttatacgaccatgtggctgctaatcagtatctccaccgtccacgtcgatttatagcatttttttttgctgctgttcgtcgatatttcaataagttttctccttcttctttttttcttttctcttttcttgctggaaatttatttgtaacggttggatacgggtggcttaaggcacgaggcgaaggtgaaagatgggcagtatacgagggcgacctcaatatcggagttctttggtttgggatttttattttaccttcggttcatatacatggatggctgcgagccaatcgacagttagacggatcacattgggcaaccaaatgaaagaacggcagcaaagcctacgcttgtccacggcaccgggtcagcataaggaattctcccatcgggcaatggcttgagtcaacaaatctatccacgaaggagctttcccacatggcttggcaatatttcaacctagcaactcctgttcatcagttggggccaggatatcctcatcttgttcttgaaagatttcccaagctcacgctattcaggtccttacttgtgtgcttctcagattctcactggttgtgtttgtttcatatatattctgttctcgactgtttgtttcctgcacccttcttacttttggccatgcacttaaatctattctcgctcgcgcggctaaaaaacaaggtatgcaaaatgcgttttgtttctgcacaactttcattgccctcccctattccctgctgttgagatctttgtgctacttgttataattgacagaaagctctaccctgctgaatatcgttgttacaatgatcgcagtctttctgtccttctgtaagattttttttgccccctccccttcccctcctagcttcctttctggtgtagtgcgctctactatgatcttcgtgaaaagaaggaaaggtagcaggtcaatttttcgagcaaagagctctactctactgaagtctttgttattgatttagcggtcgatgcccatactaacacactctccttcattgtgtgggtactatcccccggataccttatggaatcggattcttccccagggcaccaacgcaagtcaaccaggcaaaccgcttgattgataaaaagtttacaggctgggtggctatctgaggtttttattcctctggcacgcatacgttggtgaaatatatatacatatatgtcacttgggtatctatttatcctatctacattctgtgaccagtatatggatcatgattaatccctgtcatgaaaacacccctcgttcctccatgagctcggtgatgccgcgctccgaaagctctgggagaagtctgaccagtacggtctcgattatagaaaagacgagatgtttgttgcagtattcgtctgagaacgggtcgagaatgtcattctcgattgcggaaagaagtaaggactcctccacttcgtcatgccgagttggcaatgcctgttccggttcagggtttccacctacgttggacgctgtgaccctattactactcttcttttggctctccagacgccgattcgtctctgcaacgatgtcatctgccgttatacagaaaaatgctcgtgcaatggggcgggggattagagataagatatccatggcgcattgccgttttgcggccgcgatctcggactcactcggcctctgctgctgtgtttcggttagtgtcgaagactctgaagacttggccgaatccgcatcaaatccagagcccccttctgcgactggcgtcttttcattagagcgcgatgataatcgtgaaacaggagccggagccggatcacgatttgatgctggaggcacacgtccattcattgggaacaatgacgtcctgatggcaagcaagagagtcggcaaaaacgtgggggtcagaacatgattctgaattgtctcccgcagaaacctggttgggtcatatcaacagggaattagcatagccgaaactggatatcttctcggagagatggttaacaacaggcccggggcaatattccaggaatggcgtgtaattggagaatgaaaaagcatagtcttcagccaaagactgccgaaaaattggcaggggttgatatgtgaaccaaagaaggtggaccgagattgaagatgggcctagactgatggattggagggatcagggtcctaagagatcagggcctggtgcaggggatgcaaatcacctagcacgagattataagatgcccagaaccgaattgaccagggtgaccgagacattaacctgatctgatgcaaatccgcgtgtccagctttacgtcgggttggggtaacagtagtatcagggtggccgccatcctagttgggacttaaatcctaggtcggaggcaatggccttttttttgtcactggctatggttcaaaaagaggtcttgcacatcatgtgcaggtttcttcgtgatcgccatgacgctcgtggagctgagtagctatccgagtgatcgccggcctctcgtgaacatgacagcggactgaggtttgcggggtcgcagatgcgagatgacacgtccatgagcacggtccaattttgatcagatgggctctgcgacagcactggccaagagcgactggagagcggcgcgggaggaagggccgatccagggactccggaccgctcacggagccgaaagcaattcgagtaacgtctcgcaaaagcacagagccctagttggcccgttctaggacacatgctatccactttatccggcatgcggacgactggctgctggtggccggatcgctcaggtagcgtggcggatggaagcacggaagcgaagtataaatgacgcctcaaggcattaaaacagcaaagcggccgataaggatagtaaaaggggccggcagggcagcgaggcgcctttgttcatgcagccgagggacgaggcccggaagcctaggcttgggcgggaaattgagcgaccccaccaggccatgccgggatgcaacatggtgccgcgctggagacccttgtaacagtgtaagggctccgtaatggggccgtaagcctgccgtaacgattgtgacggacggcaatttgtctggacccggccaggtcccagcctcctaacaatgatgaagacgaacgaggataatagagaccggagatgatgctgtggcgcgctcactattggctggtctgcgatcacctcgagatcaagtgatcgcaacgctatgcgagtagccgacacctgtcccacgcctcgtgtctcgtagtctccccaatgagatcatcccgattcccggagagcaaagccactgaaggatggtgtgcatggcatcgctggagaatgctagtgaccctggctcccctccatgtcgccctccctgtgccatcatccatgtgccacatcttcgctgaagaagtcctttgaaaccccaacgagcataaaacaaatgatgaacttggggaggggtcaaaagaaaaaaaatgaaaggtccttactcaccgatcaagaatgccttctgtgtcgcccagcctggctgggcctgtcactatcaagcactggatgagagacacgcagccaaccagccatggcatccgtcgtggaaggtcaatgagtcgtgagagcataccaaacgccctgtactcgaggaccggacgccgcgtggctgtctttcccggccgtgaagacgcctcattcgaccggctgattggagtaggatgatctggagatgaacccaggtcgcgcgcaggcacctctggcagagacaatgccgcgcggaataggcccgtaactacaaagcgaagggtaacgtagatgagatagacagcgtgcaacaacttccacatccagagtgcgagttgagattggctgctccttgacgaatcatcttgatgctggtcctcttcggtcgaaacaagcccaaacctctccagttggcttggtcgaggacttgcagattccgcctcgccctcccgcttcaccctgtctgtgccccgtcggctcactaacgaaatgactttgctgacggtttcccagatgaaccagccctcgcagaccttcccgctcacttcttttcccaagatcaaatcagccagaacgtcgcttaccaacgttctcagacagacgttttcgagatcctcggtgggaagaaggatggccaaagtgccctgagccagtaaatgccgataagcgacctcgttttcatgttgctcggagctggttttggggtccaatggattgggaacgggtgagagagcaggatgcggattcagggtatgataggtttctcgcacggatgaaggaagggggaccagatcagatccttgtttcgcggttctataagctacaggagcaacgtcactgtcaacacataatcccaaatcaagaacgagtacgcaaaagaggatcggtcctcaccgatgatgtgggcctcaactaagcaaggaatctcatccaagaccaactgctcgacgtccacccgtcggagcctctcctctaatgcacgggtgcaatgggcaatgagctggaggagctcgtcgacgaagacatgatccgtagtgatcttcgcgtaccaagagtagataaattctttaattattattgcgattagagcgtagagctggagatcgacttcattggagcttgtcaatggcggcagcagttcgtggaggggccgtggacttgaggagccatagctgctgctctccggacagagcacacggcggatcaacgcgatcgtgctcttatccgtggctgcatcagcctgtccagatccggaagtagtctttcgtaggtgaggaagagactccgatcgcgagggctgctgggaagcatgggacgttgctgcggcccttgaagttgatgtcgtgggtccagccttggggttggaaagcggatggaaggtcacccgggaaggattgctggtcatcgcatttccctcaggcacggttcgcttgtaaagatgatgggacgactggaagcttgacacgatctctaggatgttgccgcgaaaacttggatgcgagagttgcttgtcgtagcggatgggaaaacgatgatagttggcttcggtgacgttgcggctcatctggcatgtgcgccttcccgattgaacagataagaccgataacaagcggaggccgaggggttctccgcactatatcgttaacaccgtcgagctgtcttgctcctcttccttagctttcttttttctttatacatatgatttttctcttttaggagacaatggcttcggaacctcgaggcgatgccatccccgtatggctggattgtgatcctggtccgtacccctctcagcgacacagatagcgtccaatccgctgacttgtgttcagggcatgatgtgagccagagcggtcaatttgtagttttgtgaacgactcacgatgtgcttacctggcgtaggatgcttttgcgatcctcattgctgcgcaccatccgtcgttgaacctcctcggcattaccacgatccatggcaatgcttcacttgccaacaccaccgccaacgcagggagtgtgctggaagccattggaaaaccagacataccggtatatccaggcgccaaaaaaccattttcgagacccgcagtccatgcgccggatatacatggtgagtttgtcccattggccatttatctcatgtcccatcgtaatatggacgcacgttctgaattgatttcattgcgaaggaacctctggtctggatggtaccgacctcctcccccaagccagtcgacctccagtgacggacaagaatccaatccttgccatgcgcgacgcccttcttgcccaaccgaaggggacaccgtgggtcgtagccactggagctctgacgaatgtggctctcctttttgcgacgtttcccgaagtggcagaccatatccagggtttgagtattatgggaggtgcagttggcggtgggtttacagatgctcccatgagccggttgcctggagaagagtcaaggattggaaacacgacgccgtgggcggagttcaacatctacgtccgttccccgtttcgccctggctatctacaactgaagaaattggtctgacagcttcttacgatcttgcgactagcagtgcgatcctgaagcggctctatccatactctcaaaccccatcctcgcggctaaaacgaccttgatcagtctggatttaacgcatcaagtccttgcgacgccagcggtgcaggcccggatcttgggccaaggacgacctaccggaccatcgactccgagcgttctccggcagattctgcatgctcttttgacgttctttgctgggacgtataagacggtttttggaatcgacagcggtcccccgctgcatgatccgctcgcggtagccgtcattctctcgaatcttaacccgaatttcgcaaaggagcatccagaccaggccatcatgttcgacgacaaggatggagaacggttctctgtgacagttgtgacagacggtcgccatgggcaagatgtgtccattacgggacaactggggcggacaatcgccaagccggtggaaggaaggggggttgctattcccagaggcgtggatacagatgcattttgggatctggtgatgtattgcgtggaccgggcggagcaatccagcgctgctcgagctcaataatacgtaggtgggctagtaagtattaaacagggtcgaggtattctctcctatgatcctccacatcatcttctttacatctatttgttggccgagatagagaacacaggtatatggtgtagatatatacgtagataagaaatgatctttttcagtgctagagaaagaggaatcctcttgcatcgagtgagcagtatcctcaacgaatccggaactcggttccatagggaacattggatcaaatatttcgatgccaaagcatgaagctatatctagctagatgcattaagtatcctattagttcagtttggtttgggtttaccattctctgatcgcgccgtcacggccgtagaattcacccgatcgccacggctccgtgtccttcgcaacctgcctcaccatctcctcgtcgacttcgatgcccaggcccggacccgtcagggcatcaacgtagccgtcttttacggcaaagacactggggtctttgatgtagctagtgatgtcatacgctccgccgctttccacgttgtagtggatgcccaggcccatctcctgaatgacgaagttgggggtcgagagatcgacctgcatgcaggcagccagggcgatagggcccagcggacaatgtggcgcgatggcaacgtcgaacgtctcagccatcgccgcgatgcggcggagttcggagatgccaccgcagtgactgacgtccggctgcaggatgtccacgctggcatctgtcagaaaccgcttgacatcccaccggttgaagagccgctccccgagggcaatgggacacgagatcaggttagacagctgcttgatcccttcgggatgctcagagaggagaggctcctcgatgaacagcggacggtaaggctcgagggctttggccagttgcttggccatcggcttgtgcagtctgccgtggaaatccaaggctgcgtcgagcccgatcgccttgactgtctgcagccgctggatgctggactccagcacgctgggcgagtccagccagttgacgtcttccgtcgcgttcatcttgacggccttgaatccctgcgcgagtcgagtcttgccggcagattcgacgtctgacggccggtctccgccgatccaggcgtagacagagagcttgttgcgaaccttgcccccgaggagctggtagattgggacccctagccgacggcccttcagatcccagagggcgatgtcgatccccgagatggcagacatgaagacgggcccgccacgatagaaaccgaggcgccaggcagattgccagatgtgttcgatatcactgggtatagttcagctccagcagagcggttaatgggtgggggtatattcatactcagcttcatatccctggaacctctcgcttagttcggccagggtgccttccaccgcttcagtgtgaccttcgagagtgctctctccccagccatagtggccctcttcatccgtcactttgacaaacagccatcggggcttgacgcgaaagtactcgatggtcttgattctacccatgttagagtacaatagggcagtgtaacaagtaagaaaaaagaaattcaaaaaactcctctaaagcctagtcccgtaattgatttaggggaagaaaaaaaaggaagaaagaaactcacagcgaggaattaatactaagtctccgattttcgaggactccccctcgtctcggagttgctccggatcgttcagtagaatcgcctctgccggtggatatgcacgggcatcaactggggaaaccggagactggcgcagtgggccgagaggtgggctcgggtcgggctcggtgtttgttgtttgactctgtcgacgtgcatctcacgtcaagaggagagaagaaggttggcaattcggttgggatcctgatgaccagcagcacaaattgggttccagcatcctttatctaccagtgagaatgttttccgaaaaagacaaatgtcaatccaaacaccaggccatccacgagcagaatgacttgcatatcaggtatatatacagttgtcttctaacggagactcgtaaaccgcaaattacgtgggcaattgccctgctctgtgtgcggaggggtcgagcgggaggacgttgaaaaacgagtctgtagtttcggcatcccgagagtggacctgccaagtcactcgcacagaacagccattctgctagctgactcgaatccaggaacgggctgattgtgcaggaagcatcgtggtaggccagcagccagggctcattggttgttgattgggcttttgtcctctccatctggggtcagcaacgtatgtggcgctgattaacaggaaggaaaaatctaaagcagatgacggtcagaatgaagaaattggcaataataatcttggattttctagccagagatgattgccaactgatctgcgaggcgtaaacagcgtacaaagacggaggttcaccactcgcgtcaagatggcagctgctttcgatggcaatcgccaacgtcccggcaacaaaccagctgcatcaattgccagtcgtaaagtaagaatcagacgccttgctgctggctgactgggtcctgtacaactcgcgtggagggcgatctctgcagtgctggtccgcatggctgggaattagcagtgcggaggacaggccgagcagcggccgccattcgccaacagcccactttgtcctcggccgctgcccgctcgccttctccatcccgaacagactcagcacgctgcatctccatctctccaaccaccccctcggcagtggagaccctgtcactctctgttcactgccattctcgcccgtccgccagagcgcatgcgtagtgcaagactctctcttctgaccgtctgttgccagcactgaacagcggcagatggacctgagaccctgagcgttccatcgccatgccacctgcaaacacaccttcagtaggcatcctgtgcagccttctcccatcctgatctcctggcccatccaccctgatccagcacattccggcacgggtgagatctgtgcgcctggaaaggtctggtccatcttgctgtcagctgctaaccacgacctgtctcatcttaggaaactcccgcctattcttcttcggtgaccaccatcccgtatctccagcagctggaggcgatatcgagtccggttccgaacttggcagccaccctgatcaaccctcctgaagccgatgatgcccatgacgagaacgtgaactttctgcggtctcgtgtgcgcttgtcccccgattcatcctcaagtcgcgctcggcgcagacggccaccctaccccccagagggcgaccttgacagcatggatacagaggaccagagaaacccccaacaggaggctaaccgccgctttcccatcatccgtcgccagcgcgaagggtccaacatcgtcccggactacgaaggacggacgtcaaacgtgcggtctctctacggctgggctccggggtcggatgaggaggaagatgacgaaagcagcatctggtttgggagaggatcagaccgtgaaacgggcaggaatggcgccagtcttcgcagtctgcgacccgaagggaccgggagagtaccgcaacctttcggtggagagccatcagaaggaagcagccttagtttgcggtacggggaggcggcgttatctgctgaagcattgttgcaatctgtgcgacgccagtctaggtttgccagggctcgaacgctccaaaattacatcctcgatcgagaacgaagtggtggacaagagccagacgatcgagagcgagagcgagagcgagaacgagaacgagaacgcgaacgagaacgggccggggcgtcgtcgttacgcactttcagattcattccaagcagcaggaacctccctagtaacgatatccgggtcaggttgaacgcgcatcgacagttgttttcggagaacccccccagtgtccgcctgaaagaggccatcaagtacctggaacgggtccgattctcgagctcgtacgaggagagcatttcatcagccgcggagggtgggttcattcaattcgactacttcacctgcaacgaggacgattttatcctggatacgtcgacgattgcgccgcctgcagagtgttcttggctgcggccgggctctgtatttactggttcgcaacgggctgccaacagtgtgagtgctcatatactgtcgcatcggatatcgggcccgcaatcgaacgagcctgtgatcgtgaatggcagcgagaccagccggatcagtgtctatacgaccagcggccgccgctactgggcaggaaacatttatccgccagtcacagtgaccagcaaggacgagcattggccggtcaaggtgaccatccacagtgtagactattctactatgactttgtcgggcacgatggaagcatacaatattccggacaagacctcgccgacgcgggatgcccacatcatcacgtttctggagggggagatcatcgatttcaatacacacacgttggaaacgaagagtttcaaggcggacgccgatattgacagcacctactggcgggaactgcagccgttcaagaaccttacagatgacgagatgatcaagaacctggtgagcaagcggtgggtaacggaagagctgaccaagggatggattttgatgcgatggaagggtgcgtatgcagatacatttaaaaatcccctttttttcgttgctgactcttgtagaacgctgtttcatcacaccaaccgatgctcgccaaggactgacgatctccgggttctattatatctcacttcgtcgagaaacgggtgaaatcgagggattgtattacgatccaggcagttcgccataccagcaattgtcattaaagcctgaaagggagaatttgatgttcccatcctacagctttaggtaacggcatctgagggttagcactgcttcgggtcgtacgtcttttttattcagcgtgattcagtaagtccctactcggcttttatggaatcatggacgggcgtttgctcttttctcatcttccctgttctcctttccagccagatgcagatgatttggatactatctcctttctccctaccggtatcgacagtttacccaagttaccagtgtgatgtgattgatgtttgattgattgatttttttggagtccggtgaggtttgagcattgggctggtgttctgcttcctttttttttgtcgacagcaaacatatccaattgtttccccctttcccttctcagttgcaattgtgccttgtatctaacatgagagacttgaattgaatgtacttggctctacaacagtaaacagtagcagactatagttgtgtttactagccggtaatcaatccatcaccagtgtaatgttgttattcttacctggtgagggactgggacttttcttctgtttacttttgtcatttacattcgcgtttacatctacaagttatacgtacgcacttaaaacattaaaacacacggaacggacgaacagacagttaccagtaaaatgaccggctaaagtcgtcaatcactttaattttttttctgttcccacgtcttatgtaaatttccatgcgcctatccattccatccggtaatccatcccatcacatcacagcaagatctgcacacaaactcgctgacagactaacagccgaagtcgtgaccgtgatcatgatcgtaatatgctgacgagacgacgagaaaccggaatggcacggatatgtgtatgggcgtctgtctactgctcagtctggaagtagttgagcaggatgttgcgctcctgggactcctcgccccagtcacggacgacgacgcaggagcagttgacgactttgcgggggttgccgtcacggtcgagttggcctggggggaaaaaaaaccggttagcaagcgcattctataccacacccagatatcatatatatcctgcggatatatagggtacatacacaaaccaacccactcgcccaacatcttcccatcagggaccttgatcagggggatcttgtgctcggagcacagcgcaatgacaagcttcttgtacgcctcctcctcgcagccctcgttgaggacgcacatgtgcgcctgccgccggtccagcgctttcgccgcctcgcgcagtccccgcgccaggccgtcgtggatcagcgcgatccggagcacccccttcagagcgtccagcaccgacatggagcccgcgcctgcgcccgcgccggcgtcggccgagacttcgacctcgtcggcttcggcgacgggggggttggaagtgatctcttctccgtccgacttgacaaagacacaaatgttagtgaaaaatattccttgaagagattgcttagaaaggggatgtcagattgtaccattttgctgttctagattgtcaaatgtcggattatcctcaaagagttcgtattgctatcggctggtggtggtggtgatgggagagattcggttggagttgtggattgatttgtggactggtttggaaaagttaacgggaattttttatttttcactgtcggttaatgctgagtgtgccctaaggcaggttgggaccgccgcacggtgattatgtaatcatccgttatcaatagttacccaactgggtaatccgtactgagtacggagtaggcagtttactgtactgagtagtttactcgaggaacgtattcagaactacagtttacttgcttgatcttcatttatcgtatgtcaagtccatagactagtcgtgacgaaggtagagagctatgccctgactatactgccatgccgacaattgccatgccgacagttctgctttagaggtatcataatcgtacactagacaaaggaaagattccacccataatcatcacatctaaagaaggctgcctaagcaaacggatacaacggatgcaactcaaacgtatgtactcggacgcccatgtccatagccattcgtcaatccattcactggagcagagacgctgtcgtgattctcagaaaaagcattcccgttcacttgctgactgtccaccgaggaggccggtccatcctgagctggttcgcggtcgatgtgcatcttctgaaactggatttcgagcccatgcaggtgaggaatatgcggaacaaggtccgtaaagtcggagagctagaatagaacagttagaagtccatcatcttcttcatcatgagcatccagatataacttaccctaacccaaaacacgtgctccatgtcgaaatacttgggccgtgtttccccatccttctttatgacctgccggaacgaggagtcgaggaattccgagtcgtcgacctgcaccaacatccgccgagtcacccgccacaggttctggcgttgcgtcggtgtcgccttccgcttctcccagctggtatactgagagagctgcagatcgttggtcgccaacaacggcgcgaccaggaaattgggcacccatcgttcattggcgatctccggctcgcacgaaggatcgatctgctccgtcctcactgtaaccaccggcatgaactgcttcaaccacgcatggctccgtgcgcgagggttgttcgatccaaccaggttagccgcgatccgaagtcggtcggggagagcgtctcgacgccgctgctcttgctcctcctgctctctccgcagcttcgccatccgcgcccgctcttgctccatcctcctttggcgttcctcctcagcctgcttgattcgccgctgttcagcctccttgcgcttgcgctcttcttcctcggccttctcgcgagccagacgagcagcccgttcagctgcctccttcgcatcctcttcctccttgacgattcgagcccgttccgcttcggctgcagcccgtttttcctccatgatacgctcctcctcggccttcacagcttcttcccgcttgcgagtctcgccagctgcttctgcacgactgccaacatccatggggatgtcatcaagatcctgggagtctggctttttctgctcttctttgacagggaccggctcatcagagggcttagaaacatccgcagcttccgctttaggcttggttcgctccgaatctggagaattttgatcttgacgggaggaattcttcagaggttcagagtcctggctcttcttgaccacgccattggtcaatttctgctcattatcctccgacagaacacgacgcttcttcttctggatctcctccgggtcgtgccgctggtccgaaccacgcgaacgcgacctctccggggaaacgctgctccgagaccgtttcaatgacggactggtgggcttggaagcctgtgtgtcgcgctcaaaacgagctttcgaaccctcttcgcgcccagacaacgaatcagaggacacttgactaggtcgtcgtctgtctgaatcttgcggaggccgtcccgcgataagccggcggcgcttgacgacaacttcgtcgccacgagactcgcttggccgcctttcggagctggacgttttgagcctagcgtgatccggatcgttcgaacggtcatcatcccgattcgtcttggctgatttatccttcgcttgagaaccatccctggccttgtccctgggcgtaccttgctccttggtcgaaggatctgcatgacgagtcgacgtggggctgcgcatcgcccgacggttatgaggggcaaccggagaagacgaatctcgtcggacgggccgtctcggctccttctccctctccttctcacgtgagcgtcgaggcgatttggtctccggcttacgcatctttttgttctgcatgtacgcatcgtaggccgatttcaacagctccgactcctcttcccagttctcgcctttgcgttcccgggagagctcgtagtaggtccggtcccggaacaggcgacgggtgggattgaagccaggctggtccagcaaaaggctgatcacagcgagatttcctcgaccgatcgcagctagcataggagtattatagcccggccgtagattgccattctctaacgggtcggggtcggggtctgcgtagccaatgccaaggagaagttgcatgacatcctcatggcctcccttggcagcagcaatcagagactcggtatcagctttttgtagaacgttcaaaatattcgccacgccagccatatcgcccttggctgcaaactccctcaggttttccggggttgctttggtccacaacaggtcgtttcgcgttgcctcgcttctcaccgtcctcctccgggcgggcattcccgtcggtggtggacttttcgcggtatgtgccggaggcgagtcccgggggctgcctgcggatgcacctcgagcgaccgagtccttcgatgagccggctcgcgtactgttatcttccgagcgccgcttacgcggattcgctttcgcctccgcaaggaccctccgaatctcttcgtaatcttccgcatcggatgggaccaggtcgtaaggctcatccccttcagcgtttaccaaacgaggattggcacccgcttcgagcaggagctttaccacctcgagatgtccattctccacggcgtcaatgagcggggtgtccttgtcgatgttcttggtgtcgacctcgcaacctgcgtcaaggagatacttgacgatgggcgcattaccttcgagggcagcaatttgaagaggcgtatttcccgcgttgtcgggcacattcagatcctccggacgctctgtatgcctcgcgatcacggcctccagctcctgtgccgcacaggcccgcgcaagccgcgtgcgaccgttctgatcacgctgcttcttgtgcgtcgtgggctttgccggagacgttcctgtaccgtcggaagcaagcctccgcatatgggctgatggcatgggagagccactggtcgaggaagacaccgactgacgatcctcggagctgtgtcggggacgaccagtcaacaaaggcgccggggttttcttctttttctgcagattgtctacggcgccatgttgcggacccgacacggctctcttgtgggtacggtatgtaggggatggagagcgatccttggactcgcgagggccgggcgttggatgcgtcttttcccttcgttcgcgatcgcgggcggcgtcctgattgttgttgttgttgttgttgttgttgttgttgttgttgttgttgtctacgcgtgtgcgattgtttgtgtcggtcgcgtcaccctcgatcgcaccctcactcgagctacgcttcctctcattcagatccccaccatcggcctggcgaactgcagagcccgaatgcgccgagtctcgtcgcccggtcaaactctgcgatccttctgtgttctctgtcttgaccaccgacaccggggacgacgccctcggtcggggactcgatttgcgagagtctcgctcaccttcatcgcgaggatcatcctccatgcgcttccttttcctggcagtcggggaagcccctatctcgaccgaagggccatcgtcatcgattcgaccatcgccgtgactgcgctcctgcgggacgtgcttcctcctcttttcgggggatagcgactcacggcccgactggatgatggtttcggcctcagaatccgccttgggacttaggacctcatcgccaggcacttcatctcgcggaggcagagggggtggagacgtcagcttctgatgctgggagctgaaaggcttctggatctcctcctgggcgggacggtctccagcgacatcgcgagcagcgggggcagctagcaacgacgaagaaacgacgtccacatcactcatagcgataggattcgatctctcaggttgaacgtcgtcattttggggcgccgtggcggagagaatgctcgtggacgggggaaacggacactgcgcaagaccggatcgtggtcgaccacagcgacgtcccgagatctacgagcccagcgagccaatggagaagagtacggcgttcaggggacgaatgccgttggtatggccgtgtcgtgtcgtgattgcgggagtggtggtgtcgagggcgaagtgagcggtgacaggggagtaaaacagggaacaagaagagaagaggaagagggagagagagggagaggaaagcgaggatggtggagttgcgcgagcagatggaacgaaatggggcctcgggctgcgcctctcagtggccgcattgatgggcgaccaaagaaccttccgcggtgcagcaggcagtcaagttccccggccagcagaggcgacggcttgggcagaagcaggaccccgtcagtcgcaggaacagaactaatattactgctgagcacgactctactcgatacactccttgccaggttcttcgcctgagccatcaagagcaggcatgcctggagagcactgggcaacggtggcaacgggcgagacacaaaaagaggaatggccgggacagtcgcctccagcacgctaactagcagatgcagcaataggaatcgggattcgcgctgcatgagtgcaattgcggttagccagcgttgcagcgaccccggtttcaccagacacgcagcctgcacaccgcatctccaccgcgatccacgtcgccgcgtccgtctgctgcaagttgcaacagaggccagacagcctgcctgcagtggatgcctgaccgcagctacaacaagatcaaaagtagccgggcgcctgcagtcgacgagtccagtgtcctttcatcgattcatctgtcattttgccgctttgatcgcgacggtccacagacgtgcagcgccgctgttcatggcaaggatcgccatccacggtttagccgggtcgaatgaggagagcgcacggccaagctggcttatcgcccccggcgagcgcatgaataccggcggtcgagccactgagaatggctcatagttgccaacctgcaacgatgctaggcaggtgaattgctaggcagctccggatcgatgatgactggatggccatgggcattgtaatacagcacagttagtctacgctgggtgtaaaatctttacaaagtatttcaaatcggacagatgctcaactgcgtcagttctagtaggaaagaaggggaggaatttcgctgaacaagtgtagaatacgctgccagcttgctagtaagaaattatgaaattcgaccgcctcttgcaaccaaatcgatgagattgtccgccagatcggatcaattgaggcgagcactgcgtagtagttgccttgtgcacggtcgcgactgcctctctgtcctgactcggcaaaactcggcccaccttagtagtccggggaagtgcagcagcacaaagcagcagcctgcaaacagcatcttttttttcttgtcattcaatacggagtaacgattattactcaaaactgcggtgtcgaccgtcgactgtctacaatggaaccgctgtcagcctggctatcgggaatggacgtcgtcgacgcaattcgcgcattctacatcctggcgacctgtacagtacgacctccttgtgactgaactgtctgactgtctatctttgagcgactgagatgagagaccgaccattgagttctgaggttctatcatttgcatatatatagacgctcactgtctctgccatcccctcgtttcactcccgcttcgtcctttacggtgctcgcgcgaccggagacaacaacccaccgccaccaccaccgtcgcaatcggccttctcccggtttctcgactacctagcatcatggaaggtgccgcacagatatttcacgcattattacctcgtctccgtcctgtgctccgccttctggatgacgcagcttctgacccggggtccggcattccgcgcgattgctgcccacatgagcgatgagcacctgcagaaagccatgtcgatccagcaggtcctcgtctgcgtgatcctgattgcagtccagggtggcaggcggctgtacgagtgtatggttttcgcaaagctgtcctcgtcgcagatgtggttcgtccactggctgttaggaatcgccttttatgtggcgacctccgtggccgtgtggatcgagggaacaggtagatagatatatccgaaacgtttcctgcggacgggagctgacgaatctaatttctatttcttttcagggtcgcttctctccaaaaccctcacgctcgacgatgtccggatcacaacggtcccgtccctgaaaacgctggtcggcctgcctctgtttctaatggcgtcgggagtccagcacgactgccaccactatctggcatcgctgaagaaatacgccgttccatcgcatccgcttttcctccgggtgttatgtcctcactacacggctgagtgtgtgatctatctttcgctggccttgttggcagcgccgcagggggaagtcctcaacaagacgcttctgtgcaccttgctgttcgtcgtggtgaacctgggcatcacagcggggaacagcaagcggtggtatattgagaagtttggagaggagagtgtgcgtgggagatggaggatgataccggggatatattgatctgtcctcaagaaaaaagtgaagatgatcatgaatgaagtaaatcatggctcttgatagcagatagagaagttctgatttttcttcttatctagttccgctgaaaaatcatgaggactaatagtaataacattagtttgctccactttacaatcgtagtctcatcaagtcatatcatatcatatcatatcatatacttgacaccttgacaaatcccgtcctacgagattatcaaggttatctcccgctttttacgacctatttattcatcccacccgtcaaaaacttaacactattccctatcttagccacctgcagcacatcccgatacgtgaggctgatccgggtctgtcgcgtgtaccgcccggtttcggcataccggtccttctcacccagcagatcccaattgctgatcgtctcggggcctaggtcttcgtccgtttcacgctccgcgatgccatggaggtacttcgtgtacaggtccttggttgtgatcagcagactgcgcggttcttgcaggattctgaatttgggttttcttctttgcctgtcgttgttattatcatcatcgctgttgtcatcatgtgtatatgtttcttcaggacgatcaggatctctcttctcataaatgtccagcacaatcggcgccccgagactgaccgtcgccacgagcggataatacgcagctccgtcctcgtgtggcatgatgccctggccgggctggtactcgttgatgagaacatggttcggagctccgtggggagcgtccgcaaagcacccgagagcgtcaaatcgcggcgtgatgatgggtgacaccagccaggctggcaacggcgctgcgagcagcttgttggatttggtgagtgccgacggccatgtctggagacggcggtgggagagctgggtccagcgggggagagggacggaatttatctagatggtggtgagctaaggtcagacaggaagattatcttctgcattctgaggggtccagtataatgtagggagtgaagaaaaacaaagacaggatctgataatctgacaatgacaaatgccaagatttctcttacgaatgataaagtgaaacaagaagcgttcaagcgcactataagcactcttatcaatctctcgacaaagacagcaggacagaaatacagacgacgcttcttgtagagaaaaagcaaagaccatgcaagcaatgtcagactctaccttttgaagcaatcgctcttcctcctccgcagtaatgaaatcaggaatgtagtatgcgctgtccggcaatgacttgatttttgctgcttcgagggtcatgggaatcaagaaacgatcgatcgagtgctgggactgcaattcctcggtctgatccgatgccctctgctcaacacggttggtatctgttccttgctctcgtattgctttcaggaggtataacttcaacttatctgcactgtattgaagagcatgcatgtagaaagacctgagacagttggaacgaagtagaacagatctcgagacgcctgatatcctccgtataaacgactacccaggtaggcaggtaacctgcgcggcgtcattggtcagtctcttgggtgcctcaggaacgaaaagcgcccgcctggttgccccactgctctcgtcccgccagacgagacgctcgacaattatatctatacggagtacagcagcacactcgtgcaagagaactgtttgtgtttgttcatcaagttctctcttggttcggttcgactatgccagccaaaaaccccaagggaggcaagggaaaaggaaacgacgcctccgatggcggagacaagggcaaaggaggcaaaggcctaaagccggccacttcgatcaatgtccgacatattctcgtaagtagacgatacattatatatatatctttttttacttttcaggctgacctcacagtgtgaaaaatactctaaaaaagaagaggctcttgagaagcttcggaatggtgccaagtttgatgacgtagccagggaatattcagaggacaaagccaggcaaggtttgtttccccttttttctatatggaaagatagtatggattgaatgttgtttctgtccatgtattatgaccctattatggtcctgcgttgggagttgtccggccatcaatatcgaacgtttattttatgagcttcactttatggcacggaataacacttaattactcgcgagatcatgcaccctcaatcaatatttaatcctcattacttccttcactgacacctacaggcggatcacttggctggaaaccacgcggcagtctgcacgcggactttgaaaaagtcgcatacgagctcgagcccagcacgacggcgaacccgaaatacgccgaagccaagacgagctttggttatcacatcatcatggttgaagggaggaagtagctgtactactgtttgattcatgttattttcctttctttttttctttccttctttgaattgatgtcccatcacgtgtgaaaagcagctgggttgaatgaaatacattcatgagacgaggagatagcacgaacgatgcaataccacgtgagaaagtaacttgctctgcttgtttggtatagatttttgaaaggttacaataaaccggcagacacctacattacatgtatacaatgtggacaactacagcagtagcgataatcatcgcaacgtcagacttgaatctataaccccttcatccagactatcataatcgcaaattcgtgcaaagaatagtgcacatgaagcagtgttatgagaaattataccaactggattgatcctcaattgggagggttatatagtaatagttcacagtagaagtaaaatcagactgatacttctcaagctcgaacagcacctattccgtataccgagtcagataaacacgagatagtacttaaacgtctaactgaacttttattttccggactgactgccttggaccacccggacacaagatagtaaacaacggactataatacgagtggcgcaatacctccacattaagacatcatctactacctaaatacctgatgccagatagcgccagcagccagctaaattattatcaatcagcggaatttcttacatagaatacacttttgacaatacttctagttctgcggggaattattaaaaatccatagagaagaaagacattttcggtcctaacttcagattggaactgcatgtaattgtagcagcagcatgtccagtacaacaagcgcgaaactcccaacgtacttcatcggtcatggtgagctcagatgactgttccagcttttttctttgtgtaaagctgctgaataaataaatgcaggaggagtcacgattctattccgcgacgggaccgaacccattcgatcgggtctcctcggcattggaagagaaatcaaaaggctgaagccagaagcgattgtcattacgagtgggcattttcagagcagggatgagacgattcagggtagttatccttaaaagaaaaaacagatggatattcaatagctaactaacatttactgtatatactacgcagtcaacgtgaaagaaccaacaaaagtctggcacgatttcagcttcgactaccacgacacatatccgcatgtgtatcaatacgactatccgcatcgagcctctgcgtcgctggcacggcaagtgcttacgcatctccaagagaatggcatcgaggcggaagccgttgagcgagacttggaccatggggtgtgagtacagacagtcttaactaccataccatcacgcagacaggactcggtttatatgatctgatctgatcgtctgtctgatcaggtgggttccgttcaagctcatgtttccggaaggagacgacgatggggcgttggatatccccattgtcgaagtctcgacgtatcggagtgatgactatcaggctcatatcgaactggggaaagttctttctacgctgtaagtgtttatgtttaagtcaacgacaccagcaccataacatgttagctaatcatcagacccggccggatactggtaatcggatccggaatgctggtgcacaacctgcatgcctcccagacacagccagcagaaggaccaacctacgcgagggacgtcgaagagacggcactgagctatctgaacgcgacgacggcagaagagagaacggccggtctgctggcgctgcagaaacgggcggattggaagctggcccatcccaccgaggatcatatcttgcctctgtatgtgacgctgggcgcggggcttgatgagagagaacacaaggtgtggaatcagggactcgatactgcggggatgtcgttcgtgtctttccggcttggtgaggcggctgcttgagaaatatgtctataaaagtatgctggagtgaatcaagctctgtaaatagatacagaagagatttatttattataaaaaaaataaaaatgaatatcctagctctgatccttatactggcctgaatatcatcacagatatttaagcaatacatacctacctaactactgatttggagcatagcattattgctctgagtgctaataacctccttgggagtcggcattgctgctctcgttgatatccactatcaacaaccaaaaaaaggtctaatatttcattggagtgccgactgaactagtgctctcacagtttggggtaaaaaagtactgtactccgtacatgtggagtttactaatcagtatccacttgcgtggaggtaccctactagatagagaatgagcaggtcagatagatagatagataatagtcagattatcaatacaaagaacaataatagttttccactaaactcgacctacttgctgtcattccgaataattatcgttatttaagtattattgcagttttgtttttttttttcacatcttgaccgcttctgcacggaggtggagtggaatgtatggcgcgagagcaagcatattgttagttatctaatagtgggggaggggaaaagaaagagccatcaataataaactcggcgtacactacctcgagtatacggagtattgcccaatcgtcaattatctcatcgcgatacctccatcagtagtacttaatattgtgtgatagctattcttgaaatactcaagcccgtgggggtaacctgttaactccaggctagatgggtctagttaacctactaaatcccaacttgaaaggaatcattatcacccgcatgggggcgtctccattcatccgggcagtcacctgtcgacttggatatttcggtcttcgccgcgtgggatgtcccagactcccctactccgtagtaccatgccctgcaggaagatattccatagatggagacgtaccatacgtatactccgtatgaggtagcaccctgaccaagcctcaaggtgaacgtgtgtggggtaaaaagatataaagaatcccgcatacggatccacgcaatacgtggatagctacggagtgtgtgtacgtatgtactgtactgtacatttacgttgagtgatggctacaacggcaatcacatagatagagaatatagactgtattttaatgaccatcaattacatacgagaaagaccagaatttctactttctagtacgaagatttatttagttaactgccggagtttcattaagccgggcatcggcatgcaatcaatcaacactttccgatcacttccacccagatcagtctttcgattaatattaaacagcctcaatacttattaatatagaatgctcggaaatatagcctataattaacgatagaatccatgtccactgtgagggatttatccgggcttttgcttgtttcagccctccctttttcctaatgcatcaactccgctgatcgccgtcactttcttggtcaattcgatgcgatatgaaatggatgcgtgggcagataaaggcaggatggcaaggtgtatgaattatcaggccgtttatgtagttagatggaatatgttacctagctttggctttggcacgagtatgtactgtactgtacatatggacagtacattctaaccatatacaaatcaccatgatgagagtacatgcttgtactgtactactccgtatgcaactatggtctgccccagagatagatcacctttgatagtggcctggaaaccccatctggccgcgggattccgagtgggccctctgccgaagtaggtaataatgctcaacgacttgaacaaatcaattcctcctctgtcggggttttgaataatggtaactaccacgggaattccccattctggatcctatccatctgtcctctgtctgtgcacatgcattaaggtgggcactccggggtggcagagttgcttccccacgcaaactttcttatatagactagaggtctctgttatagtatcgtctactaccccagtcccacatgaagatgtgctggacattgcttgcacactgctctcttctcgagtcctgttctttgccatcggttctgttccttgagactgactggcagtcacgttctgtgaccaagacttctagttcgtagtcgacctggaacagcattcgcaggcaattcaatgtccccacactaccacgctgctgcgcgtcttgttttcgatagctcgtcagctttctcctgatgtccagcgcctcatggtcccagcaaccaccttcagcatgccagccccggcctggtcctcaagcgcattatcgatcctcctcgtcagtctctcttccgacaggagaatgccagttcatcatgctgcacccgtccgtcccggaccagaggtgcgcctgtcaaggcttccgtcttgatgagagtcttcccggtgctcactgcgaatgtgggcatcaagcatgctatcattcccacagcgcagctgttcccccgcccgcagaggagtccccagtctcctcctccgttgcgtatgccgcgctgctggatcggatcaacagcctggaggcgcaataccaacgggacaggaaaatctggcaggaagagctgcaagaggagcggcgcgctcgacgcgaagacgtccgtgtcttgcgggaggctatgcacgccttcttccagttcatggaacaggacgtcccccggcagtttgtcgacatcgaggacaagatcgaaagtgtggtcgatcggcagcagcagctccacgagagagtgatgacggtggacgattcctcgatggtcctagaggatcggatcgctgagttggagagagctgtggcgagagaaactcgcgatcaggcggaatgggataatgacgaagacgatgttgatcacgatgaagcaggtcgcaggtcgcctgtcggtgctcaacgcgcagacaaggatctgggatctttcggacactcggtaaaaactcaggtgtcgggatctgacacgaatccttcctctccatcacgctcgtctgctactcacagctctgacccgacaatccacggtgatgacgtgattaccaaggatgacgaatctatcaagcaatgtcaagatctgcccagtctttctcaaaactcgatctctcctgctgctgcgaggacgcaaagaaatccaattccagaacgccagctgctgattcaggccattcgtgattgtgattgcgagtcgagcccgccctctgagtctgagataggagggaaaccatctcgatcgccttcgccattctcctcacgatacaggaagtcttctggatcaccaccatcttcttgcaccaccgtcgccagtaatagtgcgcgtgttctcgtgccagcaaagcgtaagagacaacaacaacacgcctggacgcttcccaatccgccgccgctttcgttgtcggattcaagtgtcgagtacggcaggtgttgcaagtgtccgaggcctgagtgagatgattgacaggctggctggctttgttgtgtttgtgtttcgcaggcatttctcatttcaaacttatagactcgttgtcgatggcaaggatattgcagaagaaactggttccattgaatcctgcccactgcttcatataccttgacttctacggcaccagccgtttggttggaattaataatatcacaaatcttggggggtattaaagaatcaagattagagttgagaaggacaatcgaccaggggattttgattcccggtagactctggcaattgcatcatgtcatacatagtaattaggccaaatactaaaactacatgaggacctcttaatctaatttaatattagtctgaggacaacaaggttgtatccaaaaagtcacccgttagttaggtaagaattctggtctaatactctagtctagtctacacaattaattaataactcctgattgaggaaccaaaactctcctttttctttcgtccatgctctaacagaacagacataaaaacaacaagacaacacagcaagagctcgaattagagctcctttttcgtattttcactgctgccgctgctttcgcccgctctttcgccttcttttccttcctctgcacgaacccctccgctccgacgccgccaaagacgagcagcacgcccagccactggccccgggtgagcgagtggccgaaccagaacacgctcagcagcatggtgagcatcttgcgcgtcacggtgacggtgacgagcagcagggacgagaatttcgacagcgtgtagaagatgaagacctgcccgacggcgccgcaggcggcgaagcccaggacgtctttcagcgcctgcgggtgtcgcgagaggaatgcaattgcggacgagagctccgtgccggctgagggtgggattggcaccgggagaagggacaggatggtgctgttggatgatagaagatagggtgtcgtgagcaggtaggtgattgtcaggatagtcgacaggaaattctgcgccaccatcatctgcggccccgtgtagcgcgtgtagcggtccggcgagctgaagacgtggtcctgcgtcgtgttggtgaggccatccagcaggaggttgatgaacagcaggaacagcccgtacagcgagcgcccgctgtgtgtcgaggcggccctcttcttggtcgtgccctggtggtagagcgtgaaggtcgcgacgcccagggtgaccagcaagacgacagcgtatttgtacagcgggtaacgcttccggaagagggtgatgtggaggaacatcaccggcagcagtttacacgatttggccaggatgaaggtcagatagtcgatgtggccgagactcgcgtagccaaacggcgacgccagcgacgaggtgatgctgacgaggatcagagggaacaggatctgccggttggggaagatcgagggcaccttctgacccttgggcgtcgagaagtacagatatagaaatcccgtaatggccgcaaaggccgattggattgtgttcagcacaatcgagaaggtgaagcgttccgtgggaggctccggctcttcagccgtcggaggacgaactggatagggtgttgtggtgatggcttcttggagaacggcccatgaaagactggagttgactattgttagccttgccaagcagaaatatagaaacaaaaaggggcagggagccatacaaagaggcgtatattcctgcgacgcatatcgcaagttgtatcagaccagggctgctgtcatgaggagcaacatgagcatctcccttcgatttcgcgttcccatttgccagcggctttcccgcatggccgttcgcttgttgcctcgcattgggctccggtagatcaggaggctcctgcatgatttccgacgagggcgttcgctgcacaggctgggcttgcttctggcgggccatgttgataagagatgccacgaccagaacagagatcaaaggcgcagacaaaggcaggacaagtcgagaggtcaagcgcagcgcacagacaaggacatagactggcaaattttatagatctggaactgctttccaccccattcagctgcgacctgcccgacaggataaatgccatgtgttcagtaaccaagttacacgcgtgctaagcggcccggatgcgcgccgaggggcggaggcgatcgcggagtcccgctcgagctaaaccctaccgagctcgactttttatcacaggattattctttgctttttgttctttctgaacaacgcacgcattgggctctattctcggactctattctcaacatgtctgcgacgacaacgacagccccggccccctcgtcgctcaccgcgctcatctcgcagtccggcgccgccgatcccatctccgcgctcacgacccagatcctccacaatctgcagtaccagcatctttggacctccttgcgcatacacaagccttcctctccttcttctgctgatggagaagcagcatcttcctcctcctcctcacccgagcagctggtctctgcttctgccatgcccctgatctccggcatccccccgcacagactgtacacccatccagatgagcaggcgtacatgctggagatcggcctgcgcgacgaggaccttctcccggagcgggtgtttgtcctcccgactgccaagggccagacctggtctctccgcaagctggctgccgtctttgactctcttcccgagcctgatgttcctgacagcagcagcgcggcagatgcggtagcagcagacaacaaggagaaagccgccaaactagcaaaatactacgagcggagacggaaggtcaacgcctccaaggaatggggcggcaagagactgttgctcgcgatggtggatagagggataggcggcgacggcaccgtggtgtactacatcgtccaagaggggaccgtgaagccgaggcagaattgaatggccagccagctgctgctttcgattcttttcagcatgtcaacactggagagaagagatgattctgcccagattatcagtggccgtctccagaccgacctatctatccttcgctgacttcgtcgggacattacctatggcgtctgggtcggcgatacgatatccattattcacggtgctgtaagggctgtagccatggcatctgaaactccttactccgtcttcgggcccatccgtacaactggtcaaattgggctatctacattaaagacgcgtcatcatgaatgtgatctctgtagatgacgtgcccgctgttcaaaacagcatactgtatattatctatgtactatacatttcacatgtccggaaaagcctcatatcctggctaggcatagatagcaaacagggtatcgagcgcaaacatcaagaacggggacaaagagaaaacactgcatatacaatcaatgcacgatgcacgccgttctgaatctgcagttcgccactagctcggtgcttgcctgttcagtttttcctgctcctcctgacagctcaggcagtaatcctcgtaccagcgcaccacgtcctccttgcgctcggcaaagatactctggttgtcgagattagcaccggcacccccatccctcaagagagtctcgacttgtcgacagcgcctcgtttcttgctgaagccagcgctcccattcactccgcagcacctctctctcgatgctgttgaccacccgcagtgcaactaccaggtcgtgccggtatattcccaggcgttgccgggtgcgctgaacacgtcggctggcgcttctctcgaccgcgtccatcggtccagacgagatcatcgtcagcggcatgtcgtcatcgagcatggtctgctcgtggaacgtcgagtagcagcgactcgtgctgtttggatgccatccagtcgtgttggaaatcgcctcgtcaagatctcttatgtagatcgctttgctcatgatgttgtccgagcttattccgaggcgtgacatgattttgaccgcatttctctcgtgccaccaatggtaggcatcccgagaggaatagaacccattgatcaggaggctcatgaacagcaatgcgagaatcacgctgtgtgcactagttgttttccagacccagcggagcaaggcaaacgaccagagcatcagcaacgagatggcgctttccagcagcgaccccatggtctctagcaacaaccatgcgagcgatcgctgttttcgagatcggcgtgctcgcgcaggcgcatcggctgaagagaactggaagatattggtctgatgccccacgtgcccgaagatgctgatcgccttcttggttcgaccgcgagagcccagctttcgcacttggtcactgactaagtcaactaaatccagagcgtcttgctccaggtcattcagcgcctgcttatcgatgactcctagatagaatgttagggcaataatcaaaggaaaacgtcataaattgttactgactcttaagcacgtaaggagaccacagccactcgactttcgagaagatggccagtttgcacttagacttggaaacgtacgtgatcacaatcttgctgacgagtcggaaattgcgtctgaacggaagatgccatggcgtccgtttatcggtgatcacgtaacacaggtggtcattgaggacatcaatgatttgatagtcagagactttggtcatattcgaacgtcctgataagtgagatatcgttagaggtcaaaggtccagagactgggtggagatgcataccgagtagatcggtcttctcaatcttatattcaaagtctcgtctcatatggccagagccgagtgtcttccacggtccctgcttgatatctgtatgtcgttagtcaagtctcagtcatttaccagagtgaatcgtgcaaaaggaaaccgacccagagccattctctcatgcagaagaagttgccacagagcactcttgtctccaaagagaacgtgaaatagcgctttggggctgatatcgaagattttctcagcggccaaatggagattcccctgcggaacgtattgcacgggctgagagggtaatttgatctttggaatatctcttccgcggttcgactttgaaggatcaatatcgtaatctctatcgatatagatgggcgttctcagatcctttgttcccttcctgtttccactgccgctcacaccgctcctaccatctaccggagcgtcgagcgagacgtcttcccagctatccacgctgggtgtcctggcaagaacttctgcttccattttgatcagagtcttgaaaacagactccaaatcaaggtggtcatctgacgtcgcttccttgatcaggaaattcagcctcctttgcaggagcctcagaggctcaaggaacgttttcacggttatgcggctcgctgagtctcccggagatggattaaggtgaagaaacaggaaatcacagtcccttcctggggcagcggttacttccatcacattggcgagcgaaatactggtcgtcagaactaatccgaagtgatgactgtagaagtagatattgcgagttgtaacaaatgctcttccaggaaattcttgctggtcgttcgggttccatgtagccctgaaaactaaaaccagactttcttcccttttcacattcgggaataggaggcggaattgcgcgtcttggattctgagccgctgtggatagtagcttggatactcatgggtgatgccgagcatagacctctgtagtttactcgcatcgccatcgaggctaacagtctgtctatgccgtggccctgatgtcggctgttgagacgaggcagggctgctagaaacgcctgtccctgcagcgatggtctccttggaatcgctggcaggagaagccgatcttttcgttgccaactcttcatcatcggcgctcttcctatctcgaggacgcgtgccctcgcgttgaagcgtattcatgaaaccccaattggaactaccccacaggttcgccatcattccactcggcattccccccgtagagtctgcgagccctacaccaatccctcgctcattgctcaccatcactgctgccttgctcatgttggtcggagctggcgggttggctaatgtgggaggtgcaagagttgtagctgttggatcctcgcggcctctgttcccatcgctttcccctggagcaacgggcataggaccgctatatgggagtaaactgtgactggaagagatgaggctggcaatcccaccagccggagattgcgtgggagactgtaggcccggagctggcgatttgcgatgaagatccaacttttggataattcgagatgcatggtcccgcccattaccagattccccatcgagccccgtgagccgccttgagctgccaaactctccactacttctgaacgttgctccatcgcgttcagggacgggcagcgttccgttacgctctgaagatggatcgtcaccggcattgggagttagaccgtctgacgggtcagctgcaaattcaggggccggaggctgggagatcgagaacgccggatcctggacagtgaactttccagagactgagatatcagtgctcgcagggttctctagtgccttttgctttgctgcttcaaatgcaccaatccactccatgagttctttctgtgtctcggcctgcagcatgatggtgtttttcttggttttaacctcgaagcagaatctcctctcttcttggaaagcaggtctgatgctgcacagcagcacgcctattcgttcgctctcctcgacacctcctgttttggagctttgcaccaggcaaccgaaaatgccattcttaaggaaagcccagcgtcgaacccatactgtccgggtcggttttcccgtgagcgttcggagattcaaccacccctgtttctcaggtctgaacggcttgtcattgtgatttctcagcgcagacggtgccttgcccaggtaaggcacggtggaaaccgagtaatcatcgagttctcgagacggtctccatgcctgctccgcagcgtcttcaatctgctttcgagccgaaagcaattctttgagcgagtatcgctcactgttttccatctcatggacccaacctttgatacggtccatatcctgtccccatttcgcgaatgtagcggcattattatcatagatcttcttagtctcccgccattggtcgaacgatatgctgaccagtagcttatccaaagtatttcgtagctgaggagcctgcacacaaaagtccatggacgccttgagataagccttgcgggcctcatgcaattggaaagcgtcctctctcaaggcagagggctccttggacttcgcctgggcagaatacctggcttgtagatgatcatactgtttctgggcctggtctagagcacgacgggtttcctgcgagagacgttgtaattaattccagcacccgataccaggaaacgtcgtcaaaccttgaaatttcgtaggtcccactgaatgaatgctctgatcggctctgcaaccgcgtggtccaattttttcacggccccgacagatgcgcccaagatatccctcacgcattcaccatgtcgctttatcgccagtagcgtgtagtcatggtcgaggacagcctccgaaatattgacaggcgttgtggcgtaagaaataagggagttcagagcctgctcaaaatctgagagctccgtggtcagctttgtcgcagccctggcatatccatcgagccatctctcaatgtaatcgagttgatcgacgaagtggagggtggtcgcgcgaaaggtcggggagtcgagggcagcttctttcaatccaacaggactgcaattcaggagtcagcaaaggccaaagaccaatcatactggaggatggctttgatcgtacacaacactgacgagcttcccaacctggggaagggcagtcggctgaggagtcgacatttacaaaggtgcagccataagaaccacgacacgttggaaggaccacggcaggacaacaattcaattagaaaattctcaagcaaatttcgaaaatagatacaagaacatagaagagtaattcatacagatgacatgacagggagtcctcacacgaggtggagtctcaccatgcagttggcgcctcgagctgatcggtctaggcaaactcgtccggggttggccagcaattggctacgtcacgacctggctcgcctgaggctgaaccagaacggggaactgccgagtccggtttagcggcgtcccccgtgacatgcccggattgggttagtagcttattgatctacaacataaactgtccgccttcaatagtcggtctcaacactcctgtttcccattgtttttgttgctaaaatgagcgtttccatgttataccgtgtatttcaaaactgccaactcgaggcgagtggggtttgaactttgcagaggatagactctcaagcctcagcgaggtcgcctctatacatgtcacgggctgagctcagactcggtgtagtgtgaatttgacagtcgagccgactgtgcctggtcctaaccccatttcgacccggaatattcccagtatttgcagttttttcaatcggcgtctctacttctgagctcaaaggtgccccaaatagcctcaattttcccccctttattgtgccctcaaatcctttggtaaccgccctcgttctctggtcaattcgctgtttgcggagcccccatcacaaatttaaatatgaacaagaagagaaaggagaagatcaagcagcgttgtaggcagcagtttttatacagcttgttgatggggtctttcctgatcagggaactgctcacgcgactggaaacctccatgttttgagaaacaagagcgcattagccagcttcacacattatatttcttatcaccagaccatacaggtgaacgcatcagtaagcagaggtagtcgatcataggatacgattgtctgaatacaaaactgtctcaacaatgatcttttggaggacaacgagacatgttatccctcacagaactgaaagagtctctttcagctgttcatgacctgtcaacagttttcttctccgacgatttcgttgctattcccatactcgtcccagcctctgcatctaccatgattcctttcctgatcagatcctcaagatcgtcattgagagatcatactcggctcgaaggccatggaacctgggactcctctcacgtcgtgctatgtaacacaatctccatcagcactgggcttctagtgaatcctgtattgatttcattcctttcacttttacgtaccagctgtcagattctctcgagagtccatagctggagatgaattttgtcgacccagcccgtgacaaagttaaagagcaagagcagcctgattttttttgcccacaattgttgcttttcatgctcaaattctttaatcttccgatcaaaattctgccagcagatttcttctctccgagatttgaatgatcttacggatatactctagaatagtttcgcatcttgcccggaaggttcaattatctctggctctatgaaggtcataaataagggagaaacgaccaataatatttaagtaaaacttcaaataaggtagctcatctcatgttctgaattgtatagactcaagtcatccttggtaagatctgaagatgatgatattagtatgtcaactcaaacaccgactttttgaataaatgtgctatatttcggaaatataaattatttttcgtaggatttcaggaaatatatagaaaatttccttatatatctcttttttatagaaactacgattcccggaacaggcgttagtttcctaattgggcaagacatagttatctacataccctcaccaaagtccacgcatcctcactatttcttttttcttcttctttttattattattgttactttcctttctccagctctaagtatccttggatgcttgtcaatgagttcgttgtttgtgtcatcatagcgcaaatgctcaaatttatatattccgggagaaatggcagtgggaacaaagctggaactttaagagggcaagacaagaaccgccccatgatgggtgtacaagcatactgtacttaccagaatctcgaaattgtaataatgcaacaacaagataagacatcttgcccaaagttctaaaaagaatgtccaaatcacgtgagggcaatgggtgcgggaagcggtgccaattccccggccgaaccagactacggagcacagcaacgcgcgtgggcggtgagtctcgagaattttctgccgcccactgataactttttttccctttggaattgtgaaattccctgtttactttcaactcaacccattgcctcattgagagactctgatctctacttgtctctctcttttattgacaatggaggagccacccgccaagaaacctcgaaagctgctcgaggacagctccgaaagcgagactgaagatggacccggaggagttccgctcaacggcgactctacggaagagccgacgttgaaaatcaacgaggaatatgcccgtcgctttgaacacaataagaagagagaagaaatgcagaaatgtatttttaagcaggtcatcttgtatactgctggtgctaacgtaacttttatagtggaggctaaatacggaaagatttctgccctgggcaagcggaagaaaagcgatgatgatgacgatgacgatgatgacgatgaggacgaggatggttctgaggattccgaggaagaatcatcagatgaggaggaggacgaagaaggagaacttgctacggaagctcttgacgcggagattcaggctacgctgaatgccatccgatcgaaagacccgcgggtctacgacaaagatgcgaagttctactcagagttcaaagaagatgaagaagaggaggacgagaataagcgggaaaagaaagaaaagccgatgtatctccgggattatcatcgccagaaccttctgagcggggcgtatacaaatgaaaacgacgaatctgaatccgcaccaccgccaaagacatacgcacaagaacaagaagaactaaagaagacggtcgtcaaagagatgcatgaggcggcggagaaccagggttcggacgatgatatggatgacgacggcggttttcttattcccaagtcgaaggaagtccccgagaatgactccaagcccgaaattgaactggacgttgaaaacgcggataaggatcccgaaaaattcctgtcagactacatggcttccagggcgtggatacccagggagaattcgaaatggcaggcctttgaatcagatgacgaggaggaagaagcgagagccgaggcttttgaggaggcatataatttccgattcgaagatcccaataaggtcaacgagaaaattgtcacccacgcacgtgatacgaccaatcaattgtcagttcgcagggaagaaaagagcaggagaaagaggcgccgagaggcggaacggctgaagaaggagcaagagaagcaggagagagaaaatgagaagaaccggctgcgcaagctcaagatggaagaaatggaggagaaggtccggaagatcaagcaggccgcagggatcaaagtctcagacatcaccgacgaggagtgggcccgtttcctcgatgagaactgggacgatgagaaatttgaaaaggagatgcagaaacgctttggtgaagagtattatgcccaagaagaggaggaggccagcggggacgacgacgatggcaaacagaagaagaagaagcgtccgaagaagcctacgtgggatgacgatattgacatcaaagacatcgtgcccgactttgaggacgaggaaaaagtcgaacagggccaatctgaagaagacgagggggaggaggatgctgaggaagcagagggcaccaagtccaagaagcaagagaaacgcgaccggaagcgcgaggctcgcaaggagcgacgcatcattgaagaagctgttgaccgcaatctggaccttgacccgacccttctccctggcgcgaccaaaaagaattccacgcgtttccgctaccgggagacctctcctcagagcttcggtctgaccgcacgggacatcctctttgccgacgacgcccagctgaaccagtatgtcggcctgaagaagctggccacgttccgtgaccctgagaagaaacgtcgtgatcggaagaagctcggaaagaaggctcgtctgcggaagtggcgcaaggacgtctttggcaatgaggaaggcccccagttcgatttcagccagcttctggcacagaaagccgctgctgatggtaccgctgccggacctgagggaggcgaccaggatgatgagatgaaggtcgacatccgggaaggaggttcgcggaagaagagaaagcgatcgaagaagcgtaagaagacatcatcatcagcctagagtagaggtggttagtcggagactcgagctagtcattgtacagggagggggaccttcaatgtcggggtattgagtgattgtatgttgattgtatacctctgtaagaaccagggcatgggatactaaaaaaatgacgggctgagatgctattcatggcgttcatttttgtttttttaatacctgagaatctcgcatataactaaaaaaaattgaactgggtattaactactacctatattaccttctaagccggaattttctctcgtcctccctatttaatccttaatgattacctaaaaatggcattctcgaaggccaaattcaactttgattttcttcttttaaactaacaggcctgctctaggacatgccttcgaaaaaaaaggcatgtaagataatgaatgcatctagttctctattcctttttttttctttttccttgtttgtcttccatctcactctctctctccagagaaattacgtagtagcccttcgcgccaattcttggctatcgtgccaaggagatattctagttcatgcatcgtttgagttgctgtttctacgtcagactagctgctttgcttgtcatctttttagcttagcatctgagcctgttggaactgggagtcagacgcaactacatattgcttccagccttatgaaaaatacaagaaagaactcattctgtcaagattgcagtcatctgactgaattgaagctgagcggctcgtctgttgtcaacggatgcgagggtaacaaaaatgcagggccaatgagggacggcaaagaaaaaaaaaagaaatcctgcccattgctgggcgacaacttgcagcaagttctccgggtgtcaattgacaagctcaacaggactttgctcaaggctttcgcccatacacgaagtaaatcaggatgtacatgtgtagctagcgatccttgatttcatctcgtacttttgccaataacacatctatttcctctttgctccagccaagaactcgggagaaaagggccggtgtgtaaacctctgccccctggatctgctgaacttgctggaatcttccaatctcctttaacttcggatcctttggccatggaccaattgggacctattatagcaaattcttaaagtcagaatggatcaagagaagagcaaacgaagggaggaaggggaagaagataaaggggatgttgtagggttcaagtggactaatgcaaacaaaccttgaaggattcctctttcacatcaacaaaccctgccttttccatcttttctttccagtagcgtacattctcaatactcttgccaaatttcgcacttgcatcacgcagtttttctagccacgactgacaattctcggcctttttgtgagtatcatcatcagataaaaagtgtgcataggcaccatcaaattcaaaatatcctccagatttcagatgttcgaatgcctggcggaagagccgatcttcatcactagaacacccctccagctcacggccatgatgaagtcaaatttgttcttatacacccaatctgtgtgaaagtcgtcgatttcaaatacgcaatttggaggtaccctaatttgcatcagcaataaaaaaatgctttcatcagtagcagaagtagtcaccatggagattgtatagggctcaagtcagtgccaataacttgagcggaaggatgtttactataggtcttagctctagcagcaaacctgtaagatggggttgctctttctcagcaaaataaatggcccagatccctgtgccagtaccaagatccaatacacgttgaggattcttgattggtgcaagctgaagtcgccctcctaggagaagaccatagatatgatccagaagctccattcgatcttgttcctcctggtcatttggctaacaaatagctcagtcatttagactccaacaaaagtttgactggctaaatataccacaacatatgatccttcatgaaacgcatggtatcgacgcccattctaaagaacatgtcagtatcctgttgagcatcgagccctagagactgacctcgtatctgtcaaccaagtcatgggttatctgttagcaagctgttggaggactcgatggcatagcgattgcattacttgtagttcttgatactggaactgagggacgacacgtagctagccgagccaatactatggcagattatcagacaaagaaagactagcaagttacatcatggtaattctaatgtactcacgattcattgtaagccgaatcagtgtcagcaagggcatcctgacccagaaaagtattagtatgataatgtccatcatagaacaggagagggccagatgctcacatctacttccaggggattattccccgcaagtgcattttgagccatggcttcaatactggcctccgcgaaggacagggggaaggggggaggggttcaaatccaagagtatggagcaggaaggcagcagccgaagtcattgaggggggtgctctataaaagaaatcgctgttccgatagctgcaggataggacaactagtctcctctgacaccatcaacggagtctgcaatgccaatgccaatgcatccctctgggtataatttgcccaatgaattgccctaattatctgctttcgtctaacgtcttgctagcgtccgaggcggatcgctgtcagacagacttcctgtactccgtagtctgtcactagtcgcatcgcttgtggtaacgtttccgagtaacgctatgcaagaattccacagttaggtaggctctactgtatgttctggcacagtcttgattagtttgtcaaatgaaagtatcccaaccccgcagaatgaacagctatatgcggcagaaaagtgcttactatatgcacagcacgattttgacagcagtatcttccttagtacagcacatgtagttatcgacttggcaccgttcacattgaggaagcatccgctgagcattaaacacaagcagaaaaaggcatgttttctcgaaagaggcagtcatgaatgtagcaatctgaggcatatggaatcattttatatgcgcgacgatttccatgtgctctgcaagcagtcgcgtatgtgtacatgtacagagtaggagaaggcgtacgcgacaagactctgtccacagggatgagcactttttttttttgagaagatcgatggaactggtgggcaaagaattcagagggagtttgcttgattctcagaagaaaaccaaggcagtatgtatgtacggagtacatacagtacaatacctacctaatgaagaaagagagacgcagcctgcaggtgaaccggtctaagcctgatcaggtagctattactggccaaaatccttgaaaaagcaactgccattgcgcatgtgaccggcctacggctcagaggacaagactgctctctctgcacatgcataattgctccctcgtaaaaattgtacctgggcatgtgtcccattctctgtacatacatacctttaatcgctgtactccgtatggcgtacggagtatacacaattacttttcttgaaagctatcgctgcatctcgcagatctatgggtacgagtaactccgtgtccgtacccaattgtctattctgtttccacagtgccttgttggacagtgtacggagtacggactacgaagtactccacacttcggactatgataagactgtgttagcccaacctcccgacctcagagaactccacttttggaaatggttacagtcgccggactggcacgactcagccttagggtgaagctgccaaaatagctgcagcagggtagcactcaatgactcatgtagtcctgtctctgagcgagtcccaaagattccttctatcccaaattttctcctatttctttgcagcttttacctgttgcactttttccaactggcttcttgctgatggctcactttcgtctacctaaggtaactgacctgcccattgtcaaacttgctaccaactcctgcaggactcaacacactgtacttttttacagccttcgtacttagaaaatttaaatgatgattttggctctaacaacgacgctacttaattattcgcatttttggaggtagcttttccaaggtctgccaggatttgggatgacttggacaaggtctctgctggttagctgaaggaaataacaaaaaaagccctgctaggtcttactgggatttttgaggttagaatttaagggcgaggataatataagctcagcgcgttaaacaactgcgccaacggagcatttcatctgaattgtttttttttccacatctcataaaagatatatttttacttgcgagtttaaggccgaaaaatcactcatccagaaggatttcgcttatcgaaatacaccgtattctttcgcctgtaccagagggagtgacgggtttagagatggtcaattgattgctattcaaggtctactggacacttgactccggcaaacattggtatgatgatgaacttgaaactctaggtcgttgtgtattccctacttgctattcttattttgataacgatctttaagccaatgaaatacttcagtttcaatgtcgacataaaatactaggcagtaggtaagtaaataaacaaccagatgcaatataaaaaatcacaatcctcgctactccgtactcctcatccccggttttcctctccactctatacctgaaactttggtttcatctaagtattatgctcagataagctagatccgccacataaatgaatattatcctagcagagagggtgccaagcagtgccaatactgacaggcatgggttatcgcatcttatgcacagcatccaggggcaccattcccaaacgggacaggttgaccggatcgcgtacctctcagtcctcggacccgacagggctgagggcgtttttttggagcactaacagtcccataatcccattggttttgggtttgagatctctttggcgtgactaacttcgtttggatgatatctttgctagctaaacaggactaggtacccatctaagatatggaggacttgggagcaagtattcctcaaagttctattcagtattactggaggagtatttgtttaatccagatcttccttgaagggaaagaaaaacactctttgagtcaaaagacatacagaggaagacttggaaggcctttcatgtcaggatgcccaagtcgtgacagggatgtcttcaagaacatcatttccaaagtgccatacagtcacgtgactgtgttttggcagaatcttcgagcttatctcgtacggagaactccgtaaaacgcgcaaacgggacggattttatcccgaccaacgtgtcagtctttggttcggagtacctacaaattacgctggtttctggactttgctttttgatattaattacagtctattcacacggttagagtaggactcttctgcgccttgctctgctttgcgcttatggatacgatatggatggatggaagaggatgccggtagccgcgacccagagttgtattaggctattagccatccgctggttattgcgcgcaattccccggtcatccggtggcgttaaaaagagacaactgatacattggaaattggatgtattaattggatatcatgtgtatgcaacaaggacatcgcatttgcccagtgcacagagaaaaaaaaaactgggtccggctctcggagagtggggatagaaaggggaaaaagccgcgaccagccgctaaacaggagaacccggggagaaggaagaagcgcgtaaccacgaatcttggagatcttttaacgggatccagagctggtagagctccaattgagagtgtcttcgagaaggagatctcgattaatcgtagtaataattggccgcattggaggaacagggactgggagtacttcgggaaaacggtgaagccggaatggagaaagcaaggcctcagagccccgtagcagcgcccctaaaggccacctgttcccatgggcagggtggctacgcggtgtgtttgggggtgcacagggaggttggatcgggagatgtcggctgtccgttgcctgggccaaggctagtgaattttcttttttttttcgcctttggctgcgttgccgggctccgttgctgctggcgccgcccgttcctgtagcgctcgcttcttcccgcttacaagaggctgcctcgctattttttctcttcctcctccttctcccttcttcctctcctccatcctttacagtgtcttgcatccccccttgacacttccccataaccactctcctctctcatccgtctttcttagttcgcgttcatcgcaactgtcaagatggccaagggcgacgttaaccaggccgagaagtccttcctcggcatgccggtaagtttttttttccttgcgctgttcctggctcttccatcgtcgaagtcatcgaagcatcatcacaatgatccagcccggtcttctgcctatcataaagccatggcgacggtcttggatgatgctgtagatggcacactcgatggatttgtcgacatacaacgtcgccatgttcagtcgctgacgtttcctgcggcattagggtttcctggtggacttcttgagtaagtctcaaacttgctattgactcaattgatcggtttcatccagaaggcgatcaagagtcaattgtcatggagatcggtaaactgacagcatttcgacagtgggtggtgtctctgccgccgtctcgaagaccgccgccgcccccattgagcgtgttaagctccttatccagaaccaggtaggccaatgaagctcatctcccattgctatgaatatcatggaatatacgctggacgggtcctgggggtaataacggctccaacgctccgtgttatcgcaccgatcggaagagaaaaatttttgctcttccttcctcccagttccaagtctcagcatctcaggctggtgtgttcggaatcagagctgaccagttgctcgttataggatgagatgatccgtgctggtcgtcttgaccgcaagtacaatggtatcatcgactgcttccgacggaccgccgcctccgagggtgttatgtccctgtggagaggtaacactgccaacgtcatccgttacttccccacccaggccctgaacttcgccttccgtgacacctacaagtcgatgttctccttcaagaaggaccgtgatggctactggtggtggatggccggtaacctggcctccggtggtgtatgttctgccttgctatcttcgcctgaggacgtgctcgctgacatccttactaggctgctggtgccacttccctgctcttcgtctactcccttgactacgctcgtacccgtctggccaacgacgccaagtctgccaagagcggtggtgagcgtcagttcaacggtctgatcgacgtctacaagaagacccttgcttccgacggtatcgttggtctgtaccgtggtttcggtgtctccgtcctgggtatcattgtctaccgtggtctgtacttcggcatgtacgactcgctcaagcccgtcgtcctggttggtcctcttgagggcaacttcctggtctccttcctgctcggctggtctgtcactactggtgctggtgttgcttcttaccctctggacaccatccgtcgtcgtatgatgatgacctctggtgaggccgtcaagtactcttcttctctcgactgcgctcgccagatcatggccaaggagggtttccgctccttcttcaagggtgctggtgctaacatcctccgtggtgttgctggcgctggtgtcctgtctatctacgaccaggttcagctcctcctcttcggcaagaagttcaagggtggctctggttaagcggtttctcaagcacgccgtcctacctgtcgatgatcggggacaaggggttcggaaagcagtgctccactaatttcttcaaggttcagcactgagggtggaggcctataaagatagaaaaatgcgttcagggcaatcttgaagcatagagcaagtggggattttctctttgtacctgttgtactttactgcctgcaagctttttttcctccgtctgtacttcctccttccatacggtctgcaatcaatatgttccatttgttttgggtcaactactcctacggtctctgcgtcagtgctgtagcgacctgagcgtcgtcatgatggtcagaacacgtagtctgtagatttcgggatttgcaaatccggtatatcacgtgtagtaaagtcatgtgacatgacgtcaacaggctgaagcctcgaggagagttacctgtattcaactgatgccttgagaattatcctcatcgtacatttattctttctggtttacattgcgcaagataatcaaaatgccgcccataaccggtatacctacatttacgtctgctcccatcaaccccaatttgcatggcaagggtggcgattcaagagcgacgcctcagacagaagagccttctcacgacgcggatcaagtccctacatcggtaagagcgtcgagcacgactgcaggagattcctcttcgccgtatcctcccgcgcgtccgggcgcagcagcagcagctcctaccccgacaggcactgctgcttctgcgccgccatcatcagcgtacacaccgacaacaacaacgacggccccagcgccgcagccagtcgcacgtccaacttgtccaggaacaacgaaatccagcgcctacaccgtacctcctccgcccaaggcaggtgagcccgttcagcccgcgtcgtactatgcgcccagacctgttagtactgcgcaagcagaacaacaacaatatcctactactataggtggtagtagtaatctgcagtcgccatcgccgtcgtcgtcgcatcattctcccttcttccaaaccttctcctcctcctcctctttatccactgcttacaataattcttcgatgatgtcgacatatcagcccccgacagcagacaggaacaatcagacgttcttgtcgcagtcgcaataccaagaagaggaagaaggacaagggattctcgacacagccaagtcatggttacaaattgcagggacgaagctggcggaggcggaggcggaggtttggagacgggtgaattcgaagacatgacataatttgcggagcgcagcgaagcaatattattattatgatgatattcatccaagacgtgagtgagggtttgtggatattggatattgaatactggatattgggtattggaattgggactgggattgggattgggattggatgtgctgtatctggtagttgtgtattgtgttgtacggagtattgcacgcgacgaacgataattattatatccctataatatccctatactccgtaataaatgcatggaatcaagttagtcgaattacctagagactggaatttagcgtccccttagtactccgtattgttcagccttgatggaatagagagagagagagagaccagctattctcgcattcctaggtatgtagatgggatatactactgctctacaggatactgttctactcccttaccacagctccattaatgactaaccacatgcgcctgttgcaataccagtcagtcgagagaggtcattggtcatagagaagttgatcatgtccagagcgcagagagctgcgcccactttgattctattcacgtcgattttcacgtttcgcctgacctgatgattcgacggcaattattaccgggattaattattattgattggcagtaagcaaacaagcgtcgaaccagccttcttttcgtctatgctatcgagactcctaagagatttcgcttcgctcccaggaggaggaggtgttggaggtggtaatggaggtggtgatagcctgaatataaggttgacgtttgctgaggcagaatctttctgtaccatacgaaatcaaatcctgggatatacttacggattcccggcaacacagatgatgcaaagctactggcaaaatcaagggcggctccttcgagcatcatgttgaagatgtacagtacctatgccaatcgtagatacatcgaagcccaagaatatcctgtggaggacagacgctactcagtgcagtcaactaagacgaccgaggtagctgaagaaaggcgcaggacgaggcagaaacaacgaccagtgcaatgcagttaagacgaccaatcgcgattttagcccgtcccagcagcctttctccatctgttaacaaaacgcgatctgacctcaccacctctctgaaaccataataggtacaggtagcgttgtgaataatgtgatactaattaaaacagatatgcagaaaacataaccatcgacaaatggatccccaagttgaatgcttccaatgtcgaggacgaagagaaaagaaagagcagcccacaagcacgaaaggcggcatagctgcaagaaccagcagaatgaagaggcattgcaatcatgtggaaaacatctttcgaccgagcattcggcgcttgctttcgcgcaggctcaaggtcaccatcacaagaaagccatgagtatcccgtaaccaatgacaaaaagtatgaggagaaaacgccgtaatgccttcataggcaggtatccgattcccaaacaagcccagttcccatgtccgtaaacccaatgtcccaattgaaaaacagacgatgtgcaatgctaaagttttattctgaatgagtagttgagcagtcgagcaccaacggcggcaaaagagaaaagaagacagagagaaaaaaaaaggactgtatctgcctggttagggccagcctcaaccagtaaagcacgaattcgagtcacatcccaaggatgtgacatgaacgacgaataaaattatccgactgcgaaaaaaaaaaggtcatgttacatagatccgagtttcaagagcgcctcaactgccgcacgctcttcgagatcgccaccaacgccgtccggaagagaaaagcccgactgctgaacaggtataccgcccggcactgacttcgccaaggtggatgaagcaggaccacccccgctccgctgagggtactgctgcttctgattcgaatatatggcaagatgattggtatttacaatgccgccgccattcaaagatctggctcggagggcatcagcgcctatatttgcccaatcctcttcgtctgtgacgtccccgtcatcccattcgtcatcgggaacagcggcatcgtcaggtgcctcggaggaggaacagtaatcgcggtcttctccgtcgagagacatcttgtccgcttcgtgctcggggtagtcgaggtcggagtgggagaaggcggcagagtcaccggtcatgctggttccataggccggtcgactgttggagctcctccactgcgagttctgagggatctgaacaccctgccggtaggagtttgggacgctggatggtggggacgagttgtttaaggcttgtcgatcccgggcgggctggccgcgtcgacgtgcgtcccagcgaccccaaccaaccttctcgaagatcacatccccattgatgcctccaccctcaccgccatttcctcggccttccagggcacccacgaccagtctgcgcgctttggcgggagggatactcgcaaacccggggaccgaagtggtgaggtagcccatgatgtggcggatcgccagggggccgtggttaagcagaatgtcggggaggtggtatttggccaacagcgcgggggtgatggcaccagcactgtctatggtgttcgtggtcgggccatgtggcggctggtcctggctctttgcatggtcgacggcgtcctgcaagtcgatatcggagtcgacgtgcacgggagcagcgggaggcgagtcggggaggttggccgcatttttgtgcttgaaggtgtgtggagaaagagtcggagagatggagttggggggagttggcagctggccatgtccctggccagggcgagcagccaagccgcccctgctgccatttccagcgtcgcgaggcttggggatgtcgacagaagccgtcttgccagccagggccatgccgatggtagatgcggccgtctggggagccatgatcgcgtcttggtgatgggaagagctgttgagaccaggatatgagtcagagccccagctcacagatccagggggagataaggggaagaagaccacgaaggtgcggcgataagagcaagaaagacgcgtaaaggccagatctggatggcaaggggcaagggcgactcacgtcagtctgcgcgactatccacgagttcgccgatctgttgacacggtgctggatgaactggccgttgacagcggacggtcagttaccaaaagcggatgtaatgcgacgcgctggcaggagatagggtaaggtacagacaggcgacaggcgactgtccagtcgaaaaaagaaaaaaagaaagagtctaacaggtcgagcaggtctcagtagcagcaagtccagatgatcgggagtgatttgatggagagaggaggggaggagggaggatgagcatagaagtagaagtagcgcgttgacgacgccctctgtcacaagggcaagggtcctgcccgattgggtgggggcagcggtggatgggaaggagcaacggatgctgcggacggtcatgcagtccggtaattttacgcggcggtcgcaggcagcggcaggtaattacggccctgttaccgcgtgctcgatacagccatagaaggagccagaaggctgttggtaccgcgtggtggccttgattggcagcgccttgctgcactgggcaatgcatagcgcgccaaaccctggggctgcctgcgccggcgccgggagcgaccggagctggtctggcggtgtccgctgtcctcgtatagcctgtcaatccctacgatagtgcacgcgcctaattcatagtgatggacctagcagaagaatcaatttctatctgtttcttctcttttcttttcttgttcataattgcaggcatagccctattcatgtcaggattgccatgcacaagcatcatgtgcatacgtcggcatgctgagggactttcaggtcgcatgcactccggactcgtctttgggcatgtgggatcgcgataggctgggatggcagtcaccagtgtgcccgtctcgccaatcgctccagcgccttatcatccgtccgttatggcacgtggatccttcgctttcacacagcctccccgcacacacaagataatcagatcagctgcgacacgggttcgaaggaatggtgtctgtgtagagccagctcgtggttccaaataatagaccgagttataggctgagtctatttccagcatagtcgagtgctgctgcgtggggttcttcctgacaagaacgcgagaccagcatgcccctcctactccgtatatactgatactaaccaacaggtactgtctgactcagtatggatcactgcgaatccttgcatagtctatttatagtgtgtggattccgtcttacaatattggtacctggttctttgtccaagcagctttatctgagacaaagaccagattacataatttcaagaccagatattgattcctgaggcttgttctatgcgacaatgttggctgtggctttctgtggattgaggtgacgtcagattccacggctggtaggatttccactgtctggatagaaataatgcaccgctttccacaggacggaatcttcgtgaggatcccgctgtcgatcagcaattgtttcttattcaaacaggccaagatcgagatctcgtcttcgacctactaactgagactgtcttataccattccgttctaccattgacgatgaaaacagtgataatccgtctgcagtctgctgaaactgcacgatataatctatcttcagatagcctcgcgacggttcctctagcgcaaggcattattgtattgtatgccttctgtattgtattgtggttccagactttggctcccgaactccacagaatcacagaccagctctaattaatagtaactgccgggaggatggaatccgagggtgggtctgatacacgttaattacgggccattcattacggagtactccgtacaataataatctcaattgcagacagcttcaatttccgatgtctgacgtcatttgtcgagtacttactcgactgtgaaagtcttctagttgcgacttctacagtacttcacactacatgtatgcatgtacttgttaattactatgcaattgacttgtagcaagccaattcaggatcaattcgcctccagcatttgatcagggggactccatgcagcgcaatagcaatgaacatgatgaaccaaccctcatgtgggcaataataatatttcgcacacaaagatgaactagggttatgacctaacttacctacgtacagagtaggtacagcacatagagccggacctgctaataaggttgtcacatgcaagtttgataggtaggtggttgtcgtcgacttgagcatttagcagaaccataattcgattcaactttccaagtaatccgtaatttctagttgaaacccattcgtttgacggatttatcacgtccactttgttctcgcagtctgtgtgtgttgtgtctcttacacgcttccatggtcacctcgataaaaagatatggagtcttttttttttcaagtaaatgagccatcaagctgagatcatgtcccagcagtaacgagcagtaagtgatcaacataccatattcatgaatatgtgtcgttgaatcggtcatctataagacacgtgactattatcacgtggtgtcacgtgaaatcatgaccatgtccatgacaagaatcaagatctcaatcgagtataattatttactccatacaagtgggaggtctgattgataaatgcgtctgtccaataaatcctccctttgtactctgtactccgtacgaatggattacatctccaaccgaggaagcacgcaatcaaggtgttcggtccgttacgcatcggaccgcgaacctgcgagttaacctatcctgttgattggggacatgtacctactcctctggaaccccacatcagcaacccatatccgatccatggtcctgtctactcctcccctgcagatacagcctaggaactgcgtcgctcgggtctttatccggtgtgattccggcctgggagcaattccgcggccttgctgcatgtctatctcttgtcagctagcctctcatcagcgcgcggaacgagtaattacattctgattgactgtgtgtccaagaagctgggaagatgagatcagatgtgatggatttatctaccggtgccgttgccggatcggggcatatccaatctaatggatctgatccattcattgactatcggttgagggcatgacgtccgtccaccagtagtataagtgtctcgtacgtcagatttgatcgaccactgattgattaattgcattattcggacggcagtttgtctgcctacctaaccgatctcctgcaccaaccatctttgtctggatggtaaactaagaggtacctctctctctgccaggtacctaccttacgtttccttcctcccctccatgtcatcgtgcagagttgcagaccctggttactattaccacgtgacacaacaagatggtctcagcagtcgacgttgacggcgacggggagtattcccccgtgcgcgaagcaggccgtatcctgaacttcctctgcaagcagtcgcaggcactgaacctgccgtccgaagcggtggccaacaaagacgcggtttcgttctactcgaccaccgaccagatctacttccccatcccgttcaaggagacggaaacgctcgccgcgctgaaaggcgtcgaggcgctggtggctgctgccattgcagatctccgctatggcccgagcacgcacaagcgaagcatccgggtcagcctggagagggcgacctgctttggatgccaggcgtacctggccaaggtggatgggctggggaagttggacccgggggtacgcgccaagctgaaaggtgtgtcatcaaagaatctatattatatttatattatattatattaagcccgattacgtctctagatacggatctcctccaggcgcagtccaacggctaccggcgaatgtcggccaacctctaccggaccaaaaacgaaggcgaattcttccacatccacggctcgttggaagccaccacgactctcaacatgatcggactggaagcgtaccggcccgacctgacggactaccgggaaatcatccgggtgattgaaagccaggtgcagaagttcacagccgcagagctggagaagatgaatgccgaaagaaggcaggcgggtgtgacggcgtataaatacgaggactttatcaagactccacatggcaaaatcaacgtgcaggaaccgccgtggaaagtcacccgtctaaagggagatctaccgcccacgcccttcccggctgcacgcagcggcgggcgtcggatcctggagggaatcaaggtgctcgagctgtgtcgcatcatcgccgggccgaccatcacccgcgtgctggctgagtatggcgccgacgtgctcaagatcacgagcccgaacctcagcgacgtgcctttctttcaagttgatggaaacatgggcaagcatgcggcggatctggacctgaagacaccggacggccggcggcagtttgaagagctccttgcggatgtggatgtgtttgtggacggttatcggcctggcgcgctcgccagactgggctacgggcccgagaagctggcggagctggcagagaagcgggggaagggcatagtgtatgtcaacgagaattgctttggatacgagggtgaatgggccggacgtccagggtggcagcagattgcggattgtgtagggatcctatcctagctttttttttttgctggttggttgctaacatgggaatgataggtcaccggagtggcctgggcgcaggggcaattcatgaacctctcgacgccggtggtacccccattcccgatatccgactacgggacgggatgcatgggggcgatcgccgcgctgacggggttgtaccatcgcgcaaagacggggggatcgtaccacggcaaggcgtcgctgatgcattacgacctgctgctgttcgccgtgggcatgtatccgcgggagatccaggagaagctgcgagcggcgcagccggcggagttttttgagctgcggcaccacgacagcgtggaccggatctcggcgacgacgctgaacatcatgagggagcggtttccggaggtgtttgcgccagcggggccgaacccgtacacggagaagtgggtttcgcgggcgtacaatgcggagatagaggtggttcgaccggtggcggagattgagggcgtggacaacgtctttgtgcgagcgagtcggccgaacgggagcgatcgacccagctgggaggatttcttggaggaggaggaggatcgcagggttggcagtagcaacgggttgaatggggtgaatggacatagccatagccatagccactagagtcgttatacatacaatctagagcagactgtatacaaaccctagttaagaaagaacctacagtacagtactacatgaacatgcctatatagcaagagacacatagaaccaaaattaacactataattagccctgtagcatgtacatatgtgtgcctatgtaatggatgatgtatgtctgtatgtacagtaccttatccgatcaactacctacctaggtaggtagttaaccgacaccaaacccgaaatccatcatctatcggatcggatctgcctgcgactgtactgcacagtacatacagtagtactgtaccagaagtaggtaggtattagttctatttatcctcattgttaattaattaaaatcatttatccatccatctatcatccatttatctatctatcgattgattgatcgatagcatcgatattagtatcgatcttacttacaaccccacctgaatacactcactacctaggtaattaattgcacggattatttatttatttatctcatctgattaatcgatcaattcgtttgtttttatttatttatttatcgtctgttcttgtactgtatatcatatcattcagagatactatctacttacctacctacttccatcaaatcaatttatcatttcaacgaagaaagatgtcctcctacaaaataacctacatcgtcaacaacagcatctccccccaacaagccaaacaattatcctccttcctatcctccttctacgcaacgagcgacgacccctccgcgcacgagaaatatgcgagggagtactttacgactgatgcgacgctcgttatgggtagtgctgagagggttgcgagggggtttgatggtatgtatattattcatcacttatttaccttgtgtgtgtgtgtgtatgtgtatattgtctgtttgttctcgttgggatttgttttttatttctgttttactttttgatttagtttacagggtatctatctagatatatctatgactgtataacatacatgtacggagtacggagggagtatttataacattccagaccggaccaaagaaaaaacaaagcgccaacacatccatccatctgtttctttcctttcttttaacccctttaacccctttgaaccatccattcgacaattcaaccattcaaccacagatcttgatgaaagacccatcctaacctgactgctctgactgcctgactgcatagaaatcctcgccctccgcaagtccctctggacaaccgtcaccgcgcgccaccacacgcccaccaagatcttcttcggcggcgccaacgacctcatgcttttcggaaaagtggcctatgtcatgaaggcggacggtaggcaagtggagattgactgggccgcgcgggcagagttcgtctttgataatgatggaaagccgaagatgaggtattatcaggtttatctggtgagtttgggttgagttgaatccagttgagatgggttgagttgagttgagcggtgctgatagagggtgattgctcaggatactgctgctcaagctgctgctgctgctgcttctgctgctgccgcgaaatgagaagatcccaatccaaatgtaaagatgcaacctgtatatagtatagttggtcgtactataaataattggtcgtcccgtacatgggtacatgccccggatacagaccgctcgaatcctgattcagcggccacagcgcatcgaaatgtatcacctcctccagaactggccccgggtccggccccaggagttcctccgctccaggaaacaccagcccctcgacgctctcgtgagcgttcatattgctggccgtcatgtccacatctgtcggtctttctcccgttccatcggcccagttccatgccgccgctggcgccatgttctgcgtagacacgtaagtcgtaacaatcccctggccgtccggcgttaccatgctttgcttcgtcgagaagaggttctcaatcggatcctgtctgccaacgtctttcgacggcaggttcgacgaccggctctcagtgaccgtcttgtggaatgcagtcaggatctgcagatatcgtgcggccaggggatccatctcggcaaagtactggtgcaggagaatcgctatctgcgcgatcgagtcgttctctggattctcgtagacgttgaaaaaggaattcgtcaggacgatcagtcccgcgagaaacatccagttactacacacgtcagcatcctctcacaaaaactctcgacggatggagtcctacatgatgaatggattcctccgcggaagacaacctttcactcggatcgtctgcaccgcccggatcatatggatcgccgagcggacgcacgcggcggaatacttgtggagctcgggattctctgccacgcgactctctgccggagagctggcgcaggcctccgtcgggttctgcggcttggacccctgctggtagatggctttcttgacgtgcagcaacagaaaaggtcgcgtgaggagaatgatcgtgctgaagtacgtcatccacagatgtagctggcccatcgccaccccgggatcatcgtgcggggtgggcgttggatgccattgcaggagttccggcagcgattgcgtccattcgtggatcttgactgcgatgtttctcgcgatccgaagcgacaccttgcgggttcgatatatctggttcaggatgactcccaggatctgggccgctcgcaccgaggccgacagagcctccgattcaaaactctctggcgacgaacctgtcttgacctggttgtcggagaacaactcctcggagcagtcttcgtcgttgatgggagtcggacgccccaagcacgccgacaagaagcggtccatgacgtagagacttctccaaagcatggtcctacacacattagaaacccacaccaactggctttgtaacccgcgggaaatacctaggaaccgacctcgacaccctttccgactcgtcgtagatgcgctgcgcctctactcgatgcagacccagagcgtaagagagccggacagccattcctggaaccatcatatcagcaatgcggtagaacgaccacaatgtatagagacatcgggaaataccgaaatacgcccacgccgtgtttcgtttccccaccgacaacatgtagagcgtcatcagcagcagtgcttggatggaagcgaaatcgccgtcctcgaaccccgaagtcgagtccttcagatgcttcgccgtcaggaagaacatctcgctgcggtcgaacttgtccgactgcagccgcttcagaatggccgcctcggcgggcgacggctgcggcgacgtcgctctcagctgcaggccattggcaaagaccaggttcaaaatgcacatccaggactgctctgcggccagggggttttgataggtacgctcaaggcgctgcttaaaggagcgttcgtcgaacagatgcatcacccctttcgtctgatccacaagttagaggccactttctcctctccgatggcagccggcttacattggcgaagaaggcgtctacgaggaaaaaggcagcttctcggtctggaagcgtatacgtgtggtggtatgcgggaggagcggatacggacgtttcgaggatcttatgtcgctggggatcgatggtgaaggcagacgtgccgacgacgctgctaaccagctgtcgaacggtctgcaggtacgacaagggggccgagtctccaatatacactacatacggtgtctctggtcagtacgacgtcttcgtctgccagtgccagacgacaactgcaggcgacctacacatccttcccttgccgtcattcagcatgcgcgacgccccctgcatctccgcctcgtccgtctcggagccgccgctctgctcgacgggcggggactggccattgacggcgttcatcgcggggaaagggtcttgcggcgggttctgcgagggcggagagaggtgcgtgctggcgggcacgctgatgtccaggctcggagcggagctggtcagggcgaaagacaggcgatggccgtagctggcgctggtcctctcagacgagctccaaccggtctcggacaggacgcgtttcttgcgattcgggtgctgggccgggacggacgaggtcgtcgaggtcgtcgggtcgcccgtggcagggacgggctgcaggaaatggcactcgacggcgcgcttgatgcagtttccgcagggacaggtgccattgcactggctagtcagcagatctgagcagcgtagggtgagcaaacggacgtactttctgcttcctcctcttgcagttctcgcacgcctgggcggcgcggatgcgattctccggggcgaccttctgacgcgccatagccgatcggcggagacgagctgcagggcgagttggcaggagacgagggcaggcagagcatcggaagcagcgtcggaagagacaggccaggctcggcaatggatctgatatgatgtactccgtagattctccagacggagagctggttgttctccgcacgtggggaagcacgtgtccggcggttcggctctcggcagcgggacttctccatcggctggcagacgtcaaccgttcgtcgccatgacacaagacgacctccgcgcctcttaaaggctaaggtcgcccagcatggccagcagcactgtttctgccgggtgatcgccgcgagctctcctctccagccatgcccttcgtcgacatcgaccagaaacggctgcactacgccgattcgcacccccagggcgcccccgagggcggcctgaccttcgtcttcatccacggcctgggctcgtcgcagaactactacttccccatcctgccggacctcacgccgcaccaccgctgcatcaccgtcgactcgtacggctccgggcgttccgcgtacacgggcctggagcagagcgtcggcaccatggtggccgatttcgccggcgtgctggatgcgctgaagatccagaaggcggccgtcgtgggccactcgctgggcggcaccgtggccctgcatctggcgaccaagctgccggaccgaatcgtggccgtggtctccatcgggccggtccatccgacggcgagcacgggcggaatctttgagaagcgcatccaggtggtgtctgaaggttggttgacatgcattcccagcagacacgagctgagttgatgacgatgatccagacggtatggagccgatggccaacagcatccccgacgccgcgacgggatcgcgcagccgaccgctgcacaaggcattcatccgcgagctgctcctgggccagaacccgctgggctacatttcactgtgccgggtgatctcgacggccacggcaccggactacgcggccgtgaaggcgccgtttctgttgattgcgggcgacgaggacaagtcggcgccgctggacggctgcaagcacatcttcgccaacgtgtcgagccagaacaagcgattcgaggtgctgtcgggggtgggccattggcattgcatcgaggcgagcgacgaagtgggcaagttgattgccaatttcgccaagacggtggcagcagcataatatagagtagaatatccaaaatatccagtttgttaatcgcgaagaaaaccataggcagtagattacatgaattatcaccttgtcgaaccctgaaaatcaacagcagtgaaaacacccagtatctatcgatctcttttaacagtggataaaatccatacacagacactctcatataccatgacctaatactatctaacaagaaattttttttaaaaaaagacaataataacaacaaactggtatcataatctctcctaaccatatcacccactatttcatttaagctccccattaaccttcccctcagcaggcaccagcttcacatcatagttgagctccaacccagcctgcggatcgtccttgcggggcacaaagtcgacgatcagcgagtccttgacggcaaacaccgagtcgttggtgaggtacgggtcctggcggtcgaagatctgcgtcgtgaggggcttgtaggcgtcgtgtgtgaccagcaggtggatgtgcgctggacggtaggggtgtcggtccatcagttcgaggagtttgcctgcagggcctgcagatcaacctgtaagctgtctgcacagacactataaaactgagtatatttgtagataccatcattaggaaccggatacggcgtcggccgcagacagtagaaataatatctgccctcgtcatccgttctgaatttcccccgcaggttgtgctcgacctggttggggtcctgctgctcgtacagtccgttggtcgaggcctgccacacctcgacgacggcgccggggacgggcttcttggtcttgaaatccagcacgcggccgtgcatgaagaccatctcgccgtcgtcgacgcccgtcacgatgctgtcgccgttgttgcggaagggcgtgtcggcgcggaagaacgggcccaggatggcggttgcggtaggggcgtcagattcggagacgactttgtaggtgatttcgtcgacgaggctgcgtcagtcagtcagtcagctacctcagtcagctagctcaattgaatactcgactgcacgtacgactccaacccaatcacatcgcacagcagctggccttcattccgcttctcgtcgctcatcttgcccgcccagttgatcatctgcacgcccgccatccactcgtcgacggtgagctcgttctcgcgcgcaaagtcgtggatgtgccggatcaggctggccatgagctggcgcatgcggggggaggtcttggggcccatggcctggatgacgcggtcggtgaaggtgggatcgtatttggtcattttgtctgtcgtttactccggatgtctgatgggtagtagtaggtatgatggatatgatgctctatagatgcagagtgaacgagcagcagactatatatatcctgaacacgacgtatccatatacggagtacctgatgactgctgtatatctctatccaaagctgacagctatgctaatcctggaaccccgattcgtcctgaacccagacgcggccaatggcttgctgccgaggccagagatccgaataaccggccatagtatcacagaatgcaattccacgcgccagacagagcagagagcatcggatgcggtacagcatgtgcgtgggcaaccccgctatccgaaatgtggggagcgcatccatcggatcggatatggggaagagaatagattgaatgataggaatcgtaattattattacttgcggagtatttccttctccgcacggcttagctaatgtctgtccctatgtccgctcaccaattcgagtacgggttccagtatactgagtagtctgtacaaggacagaaatgtacgtcgatcattcgataattcatgacttgccagacaataattattctatcagatatcttatctatttgtcagattcttaacctagacctactgctagctctagctagccacctatcgattgtcgatatgatcgtgcgaagaccaacagaagcatcagtagactaaataaaatattttattttttgctattttctctatttatttctcttccccttcgcttcccccctcatcttcggattcttcttgcccgccagctcggccggcaactcctgtaccacccggccattctcccacaggatccccaacccgaccttgcgctcgaccaccacatcaaaaaactccagcgggacgaccttctccttcgtctcggccgactcctcgtcgtcgcccccagctcctctggtcacgtcgataccctcgctcagaatcaccccgttctcgctgcggtagaacggacaccccgccgcgagcgccttcttcaggtcgatgtagatcaggatctgcgcgtccgaccgcatccccgagatgaccgtctgcttctgctgctgcgtcggccggccctggcgcccgttcggcaggacctcgtccagcgacggccccgtcgcgaaatgcacctgcgtgcgccccatggacttgagtcccccagacgccaggatcagcggccacgcgccgtgataggtgccgtggacgaccgtgtctggcagaggctgcgatagcggcggatcgtctttcagcgtcagcttctcgagaaacagcgtcgtgtcgacgctcttcatgctgtggccctgcgtcgcgcggatcaggaagtgcgacggatcggtatccttgacggagagagcgtgcgccgtcgcattctcctgtttttcctctgaactcgccgtctgggcggccttctcctgctgctgttgttgctgctgctgctgatcagcaggcggaacgtacagcagcgaaaagcgcttcttgtccgagttggcgacggcatcaaggatctcggggaacgtgactttgagggatttgagttttctccacgcgagctggggaaaaaatcagcctcagaagagcaaaataaaaagggaagaggaggacataccaaatcagcaacattgacatatccctccgggctaatcttcaccttctccttctccgccgaatgccgcaggagattggacatggccttggagatggccacttcccgggggagttctctgcctctgcgggcagacatgtttgccagggaaaatcagcgatgaatctttctcttcactttccagaactgttgttttgttttttcttttttcaagccagcaaattatttgtttattcccttgcacagagcacagagacaataaaaaaaaaataaaaagaaagaaagaaactcgaataaagaagaagctgaagcagaccctgaatccaaatatctgactgaagatggatcgatggatcgatagatcggtagatggatagatattcacgtgcgccgcaaccttaagtataaatgacctgcatgcactaataattaatattagtactgattcactcactcactcgtattcagacttttatttagattagatagatagactcataatgactcactcactcactctatttgtatatgtactgaatgtcaccagtaattagcgagcagggttaattacctagttagcgtctctcagctagactctgaatcgattaatcatccgagtcttttctttctttctcccccagagtgaaataaagtaaagtaaagtaaactgagagttcctctggtttagtggggtctggcttgttgctgctctgcagactgcagatcttttaatatttggtgaatgatgatggtgggtcttggttgttaacagttttacagagtaactttttggtggctctgctctctaatacgggggtttgtgtttccgctgtggatggctgacatcatccgcatagcatagttaacacgatctctatctatagaattttatagatactacactacacatcaacaagacaagcagagttggttattatacagttaatacagacagacatttatatgcctacagtacaattgtttagtcgcaaccatctggcaagttactaaactaatccagttcgatactcgtatcttaattatcatctctaggagtaatgtacagtacactatgatgggtatattacaacaattcaagactgatgcacaagcagaatctgcctatctatcacaggcctatctatgcaggcctatctatcgcagatacagctgcactccgccaccggacacacctgatgccgcgcaaaccagtctcgcgcgtgattggcgtggaacccgtggttgcaattgatacaaaaaaccacaaaccgccgcgtcagatcatcctcggtcggcttacggttctctttcgagtctgctgccacggccgcccgcgacatcgggtccggtgacccgagccacaacgagcacactccacaccgaggcatgtgccgctggcatttcggacacactgtccctgacatcgttgccgaacccagtggatatcccggcgtgctatggaccacttctccgctcgacgtcgacgcgtcttgctggttcaacggccgcgtgcagtagttgcaagtcagactgacctgctgcggaggcggcgatatcagtcgccgtccgtcccaggtgacggcgaatttgcggcatccgacgtcgaatcgcgcccgctccagctgcagcttccacgagttgatctgtcggcggtacgtctcgcgccatgcgcggaaccgggctttgctggcctcgtcgtcaatgaaccgcggaacggtatggctcatcgccaaaaccggtgtctgaacgtcgttgaatttgttgatatatgactggaacaggtccagcgccgagtgccgcagccccgtcagaacaatcccttcaatatccccttcacgaatcgcctctgcggttgtctccctcagataggcagtgagcgcctcatcgggcagccatcgcaaggcaacctcgacacgatacctcagcggtagtgtcgtctcctccagcaccgactcccagtcgcccttgcttaccagcgcaaggatcgctctggcgtatgggtccgtcagctctttggcgatctcggcacacgtttcctcccagtcggaatccgtggtttcgcctttcgtggccccggcaatggccatcgccaggagtttgtgagcctgtgtaggctcattgttgcgcagagccaggaaagccagtttggcctcgtcctggaacacagcaagggcagctgctttggtgtgctgtctttccgcgacaagcttcttgacgagctcctccagttcgtctttagactcgattgcaccgcatatccgaagacagagtaggcgatgctctatgaagtcggtttcacatcctcgactctcggggatgtcaagttgctgaaccaagtctttgatagtttgatcaacgtcaatagcatccttgtcggccgtgccctttcggcttcgaaagtttggccctagcgagattaatcagtacgaaacacaagtagacggcccatgtattacatacctaaatcattattccagatgttgtacacaccgaggtaattcatatcaacatcattgacaatcatcgaagagttcgaagcggcatcccgtgcgcctataattgttagctaaagccatatatatacgtatataggtctgtctgagacccacgtttgacccagtcccaaaattcctgtaaagcaggatcatcagcgacaatctgcttatttttttcgcagtcaaaaaggtagccctctttgcagcgaaaccggttcagagtcatcaacgtcaacgcatcttgagccttgagaaccgtgcctcgagtgcccagcaaaagggcatgttccctactttcacggctcgacaggcagttggtcttcgtgccattctgctcctccgactgcgcccgcggaggagactgagaggacacacggctgcgtatatcctgaacgacttcggatatgctagcgccaccggagcgaggattcattatctgaaaatcacggtctccatgaggccgtccgcgcaccagcacactctgcgatgacatccggacgttcggacacggaggctgaaccgtgattatctccaccttcctatttcccagcagagtgatggcgctgggttcgttggaaggactcatgttgagaaaatcaaaagagaccaccctctccgactgcgggcagcccctggtcgggtgattgaaaggactgtggatgtcacggacatttttcgtgtagatctgctccgggtaattggcggaagatccctggccgagcgtggtatccagagaatggttgttttccgccgatacgcattccttggcgatgtgatacgccttgaaatggccggtattggacaggactcccagaaaccctcttttggtcctcgagaagcgcaggctccagatcgaagcctttgagtccaggacgtttcggagctccaaagccggcccagactgacctgcctctggggtcccggaattcgcagctgacgcggtcaagcgcagccccatccgacgatcccagatgcagaccgtgggctcatttgacgcgcaggaggcgatataattctcatccagccagtctatggccgtgttatggacacatttggtcgggaactgaagaaacgcttgaccggagccctctaatcgatgtcagacagtcgcaaacttgggattcccacaaaggaacaatatagataggtaataacttacccctcaggtcgtacagcttgaggaactgccccttgacgcccgcgaccagcgtatccggctggtctctgaagaacttgatgctagtaatcggctccgagctggcgagcttcctgagcggctccgacgcatgtcgatcggcggccaggctcccccgagtgtgtctcacggccagacggtggtggacgtcccagatgttgagacagaagtcgttgcggaccttgtccaggccgccggcgagcaggccgtgcgagctgaaggcgacggcattgcagtagcgctggttgcgaatgggaaaggaccaagactcgctcgagtcgccgtccatgcgcagcagggtgacctcgccggaggactggcccacggcgatcagggactcgtcggcggtagaccaatcgaaggcgcgaaagccaggcactttatgatgggtcgacagcacctcgtagtccaggttccggccgtcgaaggaggtgacgcggcacagcctgaaggacctgcccgtcacgtcgacgtacaggaaacgctgctccctggccgtggaggagggagaccagcgaatggcggtttccatggctgctggcaggctgcgagatcatcagcagggcaagcgaggggcgagatgtgtgatatttgtccaccggagccaacccgcatgcctcatcaacatgactgagcatcacaagaggccacgctcgcgggcgcgataccgatcgagcgtgtctgcagaaagcaattgcagcgactctggactgcccgatacggcgatcacgctgatgccgcatgtcacatgtgatctcggcgcggtgtcgggccggctgatgatccgcgcggacttgtcccgattaggcacgcgacagatttgatatcgaaacgcattcaaaatctacaatggcaggaattgaaatggatgaatgaatgaatgaatgactgatcgagacttctaacattactgcacatagaacggagtacatagaaatcgacacaccaaaccagaactacagtacagtacaaagtgcgaagacagcaaaaaaaaaaaagcgaactttaccaacatggctggctccagccgcttccacccctacgacaaagcaaagaaacacatcaaaccccgggcgcacccgggcccatcagtcaacgagctcaagagacggatccgcgatgtcaagcgcctgctcaaccacaaggagctgccggcggacgcgcggatcgtccaggaacgggcgctggccgggtacgagaaggagctgaaggaggagctggagcggcgcaaacggtcggagatgatcaagaggtatcattttgttcgatttctgggtgagtctggactttatacagccgacgtcaataataccaattcttacgattattgattttttgttgtatacagatcgcaaatcagcaaccaaagaactcaagcgcctccagcgccgacagcgcgagatgaccgagtcctccaaccccccagctaacccagaggcattggcacggatagcggagaagatccgcgaggccgagatcaacgtcaactacacgatctactaccccctgacggagaaatacgtctctttattccctcacgacaagaagaaacagaaacaagaacaacaacaacaacaacaacaacaacaacaacaacaacaacaacaacaacaacaacagaagaaagagtctacagacggcgagggtgacagcgacagcgacaacaacaacagtgtaaacggtactcccgacgacgacctcaacgccctcctcctagcaccacacaccgacccaaactccaaaccaccaatgtggcgcgtcgtcgagaaatgcatgaaggagaacacactcgatcttctccgtgaagggaaactcaacattggcgtggacgggaagcccaaaaatcctcctcctaataataataataacaacaccgctgcagagcagaatgccaacggaggaaagtcaggatcgtcgaagcagaaatcgacatcgtcaacgacgacaaagaacaagaaagacaagcagtcgtccgattctacgcggaaaaagcgtggttcccggaataatgacgacgatgacgatgacgatgaaagtgatggagggttcttcgaagaataggaataaaaactcgatcatgtcatgcatgtacattatttttcttttctactctattactgagatccatacatacgcatacgcatacgcatacacatagacacagatggcggggaaaaaaagacttactacatatgaatacatgtaattactagagcatatcaatgatacccaatctgatctgaattgaattgaattgaattgaatgaaggtcatgatttagttaaattgattcaaacgtcgacttcaagaagttttcactaaatagtcaggtagctagtttcttctactgactgattgacatcattcattcatgtattcatttcattccatttcataaccgtgctaatctgtctgtctgatctgctgagtaataacaagatgaaccttacaaactccgaactattctatcgagatccataagtgtaaaggaaaggaaaaaggataagaccgatatcgacaaattgagtcaaatcaaatcaatcaacagtcaatcaacaatcattccctacccgaaactccccccgcctgcctccctgctaggatgatcaaccgacaaataacactttccataataacaaagtggagttgcgcgtttaacaagccagtaaactgtatcaccccgttgcgccttgcagacggcaacgccgtgtagtgtaagtgcaaaccgtagttactccgaccagaacaaaggaaagaagagagagaaatgaaatgtcaaagaaaagagagtaatggagtactgtcttcatgtagtcattcgttcatgggtgaatgtcatctcgaacacgtggacctgcaatctcctgccacctggctcaccctgatagaataacatcatgcaacctcactcagcagtttatcaggtagcgttcccagagatgtcgatggatcttgcgcaggttgcggcattacattactatgcaaccgccactccgcgctcgtcgtcttctccccgcgagtggtgatatgatgcctatgccaccatcctcctcatcatcgttgaacagtctctctgcctcgcgtacgcgacgtctccgtcttctggctcccgcgcctgccgcgccagcttcctcggtggccatcatgtaatccgcccatttacgatccagtctggcagctgccgcaagatcgccacgcagcacccgcttagtgtgctcatccaccgtcatttgccagccatagaagcacttgagctggatgatctcgttgggatacatttgaactggcgcgggcggcgacgacggcgaagcatcactgctcgcagacgagggcagtgaagcatcgctgcgttcaccagtctccgtcacggtgacccgtgcggaaccagtcttcagggaccgaggcagataggcgttgctcgaaagaacttcccggacaccggcccatgtgacgttgatacagtcgaataccaccagccgcagcccgactcgtggcaatgaggtcccatatccacgcttgcggacccgaaagctggcctccatgagggaaagatcggagatgcgcgtgttgtccatatcgaccgacttcaaacgcggacaactcttcagcacagccagcattcctggatcacccaggttctcgcagtagctgacgttgaggtgttccaatctctccgcacagggggatttggccagctccaccagagtgttgttggtaatcttgtcgagatcctcgagctcaagatgagtcaatcttggagtggtgcggaccacctcgatgatagaattatccgtgagctccgtgcattgggagagctgaaggccttggaggtatgggacgttgtgggcgagacttctcacgccgccgtcggttaagagggagcattgatggaggtccaagtgcttgaatttccgcggagggacgatgggtcgatccgtcaggacgtcgatctcggggttggtcccatgaatgagaactttcaagctccggtcggtgacgtccgtccgatgcatgatcagcctctcgagggtattcctcttgaagagcgcttccatgaaggcttcgtcatcaaacccgcggatttcaccagcacggaggtccgtcaactccgaacacgactcgacaatgcgcttcaggcccttggtattaacattggagcaccacgacacattgagggtcttgaggtgcgggcacgactgggcaataatcttcatggcagagttgctcacactggacagagcggaaatgttgatatactccaggcgtgggtttcggagcaggaagtagtgaatcgcggttttatcgatgcgacacccttccagagaaaagttgacgacgttgcggcaggcatccgtgatccgctcgccatctgacagccatttgtccttcagctggacgcagcctcggaggttgaggtcccgaatgaaagggccacccgaagtgataatcttgacgagggcatcgcttgagatctggctatagaactccgacgtatcgatgcgagaccacagctgcccgtcaaaacacatcttgtaccactccttggataccacggagcaccgaacgatctccttgggagtcaggtagcggaagatctccatcttgatctcatcgggcatgtctcgccagaagtcaatcttccgtttgaccggctgaagggcggcggctgcttcctcactgcccatctcattgaccaattctgacgctggctcgccagattcccgctgcatgcctcgagaggtagggcgcagatccgccggtaagggaacggtcgcttgagaagcattggggagagctccgatgagacggattcgagcactgcctggagatggagcaggcgagacagggtcattgggattgagtcctccatagaactgagaggaggaagcactggggtcactccagcatgcgccgtgggcagccggtgtcaaggagacgcaagaaagggaagccttgccatctctctgatagcctaccgagtatgatctcgtccgtcggaccaaagttgggcttgaagacatgcgttgcaggctctgcaacaacctctggcgccccttcactttcggaggctgctccaaaggaatctgtcccgtcgacgtcgtcggactgggcggggaggccgtcccgggactctccactacctcatccgttgtggaagtcatgatggtcctgtgagggttgtcacaggattgtcgatgtgaattctgggggattgaaccaagtggaactaccaccgtctggcaacaatcaaccgcccaggcccgagacacaatagatggaaaggctcaggatctacagagtagaaaataacaggcaaacagaagcttgggccaaatggacaatgccttgagatgtcgtaccggaagcgagaccgcaattccggggcctccgtctagtagaaggtcatgaccgggatatgtgaggctatccacagacgacgtcgacaagacgagacacggcggggttccctctccgtccgggagaggtgtggagggagaaattaatccggcgtgaggccgagaaatataccagagagagagactgcggccagagtgtatgggagaggggcagaacaagacggtcctgagaggtaagacgcagtgggctgagtgacggtgactgatttgcaggccggagaaggggtggttggctcaggccttgcctggaccatggaccgggaataggaacaaagcggtaccagggagctgataggaggtaacgtcagtcaggcatcacagtcatccagacgagggcaagggagaattgcgataagacagagacgcaattcacgacgaagatggcgggagaggaaatctccagaccaggtggacaggcgggagagagataacgagggcgatcggcgtccaagggcagagctgatggaaaaatggcaggggggaagggaggggagggacagacaacgaggtaccggctacgtaccaggaactgagttaagcagcccactcaccacccatcgcagggtcagacagagactcaagaggacagagtcgagctgtcgagtttgggagggcgactgggagaggggagcgcagacgccagccaatgcggatggacggcggtggggacgcggaggccggaggcaaacaggctgctggcgctggagagacagacgacgatggcaaatctgtgatgctgatgcaaatcgagccggatacagctggatcagccggtggagagcagcagtagaggcagcatttgactgggggggtctcagcgtggcggctgcttccccgccggcgagctgccaggttatcttgggatagacttatcgattagcgataaccaatgcgctagccgcagcggtggaatccactagagcgtgaatgagagctgtcaggcggcggccagagcagcggtggagccgacacgcagcgcgatggccaaggattgacacgcgagcacagcgcctgagctggtcatccgtactgtacaggatgtgacaattattgctgccatgggcctcagcaggcacgtcaggctgtctgccctgcagtgtcacgggtagccactgcactctggcgctgtggctcgatggcaccaccccccgccaaccggaggggtcctcgccagactcctctcagtcagctgctcaacgccctcctgcaaggggccttcgtcgacttttcttttctttactcccttccccccctctcgtttacgcaaaccaattggtttgctgcaaagtaaccatggtcaacgatgctatccctgaaaatgcagatttttttttttgtttcgtacatacacgaattaactaaggctaaccgctccaaagacaagaacgcagaaacagaacaagggaaaagctaatgggtatcttgcatccatgcttctatccaacaaatcaacatcccgtcttctctctctttttctttgttggggtctcatgctcgcgcgctctcggctgctgatcacatcttccgagtcgacaatcgaaatcgagaagaaaaggagcgtggttgcagacaggatcaacgaggcggaagaatggacagaatatcgcatggtccaacgtcggtcatcgccaggaatcgaacaaaccgcaatgtctctctattcatgaatccatggctgccatcatttcagggaacaggtaatctcaaactctcaccgaagtaatatatagaatcaaagcatatgcgataaaaaaaaaagagcggggcaaaaagaaaaaaacacaactgcgaatggtcttctcggttgacatttcattgcacatgataggggtatcgtgccacggtccatggatcgtagaacatgtcgtgaggcgtgattccagtgagataaaaagaatatcgatcgtacgcactattccagtggtgggtttagtaaaccagcacgttccgggtgtcgagagaatagaaagctcaggatgccgtcatccaagggtgttccataacttctgtgatcgtcagtcgattgtcgacatcgcggtcaagcattttccggatcaggtcgatgcaatcttcggaaaagggaaggaagggcacacgcagcggatggtcgagaatctcatcgacgttgtagaacgggttctctttgtagacgatggtgtaaagcagaattccaagcgcccacacatcttgttccttgccgcggtaggatttgccctgaagaacttcgggtgcagcgtagtctggaaggagaggtcagctttcttcattcctggaaaatgaacagaacggctagcttaccaatcgtgccgacaaagacgtcaaaggggccattcttgatgtaggccgcgctgccaaagtcgatcagtttgatccggccttgtccgtccaagatcacattctcatccttgatatcgcggtgcacgaccaatgccttggtatgaagatggtggatcgcatcgaccacctgtctgaatatgtttcggcactcggcttcatccatattcgccctcagctcgatgtagtcaaacaaatccatcccggggaggccatgaggcaccatctcgatgtaatagttgacctcatcttcgaaaaacccttccatttcaacgatgttcgggtgcttgagcccgtcccgacggaggtaatcaaggacgtggatctccaaggggacagtgcccaaccgacgatcgcgtgtccacgtatccacgagaatcttcttcttggttacatacttcagcaccaccttcttggacggatcattcttcaatcgggccagcttcacttggccgtaggcgccttggcccatctcttccagaatgacatagtcggagatgcttctcttcttaggtgtttcctcaacgggtggtgatcgcttcgcttccgtaactgcttggtctacctgatccgacagtggcgttgacgcggcttcattgagtttttcgctcaggagggacattgaggcgctgttatccaaagacggagtattcgaatgggatggtagagacggaagaggtggtggtgttctctgtccagtccggggttgagcattaggcgtagagggccttgctgccgagccgtctacagagaaagctccctgatgaggcgcgtggatctgcttcgaataggtgatccatagggcgtaaacgacctcggtgacagctacagtgtcaccatcatcttcgtcgtcatcatcgtcgtcgtcgccgccatcgtcctcgccattgtcggatgctttctgtcgctcagcgtcgcgggcttgactgtctgggaaaacgctctcgcttttgatgatccgcatctgaacatccacggagatctgggatccgtcacgatgtttcgcgggaatgccggtcggctccaagaatatcgaggccgcattagccttgttttcgcgaagaatcgaaagagcccgagcccgacggaagctatgctcaggtatgaccatcccatcgaccagagctactttgtcttcctctgttagggtgcgtaagaagacctcgaaaccagggataagctctgaaatgtggtggccctcgggacgttcttggccaaagagagcggcagagaaaaccgaattcgagctgataatattcagcgtggacgatgaaagcaccatcattccagcaacatgtggaaagctagaaacccgtaatgagcgagttccatcagcacccttggtgacggtcgtggggatgcaatgtcccccagcagtgcgggcggcaaagtatttgagttcggtgatcttcgttatgccgttttctgtccgatcttccacacagtccttcggcaactgagggagaagttctgtaatcgacatacccggcttgaccaggtcgtgaccccagattctatccgtatcacctttggcgtcgaggacgcgtcccgtttcatcatagtctatatatgccacgttttctgtgatctcctcaaggacccagatcaatcctccgcgtttctccatgacccacagactggcagagcccttggaaccgttgcgtttttgaatgggcacaacatcgccacagaggagaactccacgagatttagtcgcagaatgatttggttttctcgggtttcgtgtactagagccgaacccatcgtcagtctgggctcgtcggactgcctttcggcgtgaagatggtttgctcaatagctgtgccgtcaccccgttacccgttcccatcgacttcggattaacaggactgaatcgcggctttccagaatttgggaatttcgcggtagcatccgtactgggatcctgcagcttggcttcaagccactgtcggcgctcttcctgtacaacctccagtatgctcagtttccgcacttcagcctgcgtgaccccaaacacaagacaggcgaggtcgttggccgccagaatagtccagggcgcttcggattccgtcctgaagaccgcctgagagactggggtccatttgctactatgagcgtgcaccataggacccgcaacacccaaccccagagccgaaatggctggaggagagaaaggatctccggttgcgtatggttgcgccaaggtctctatcagcctgctctgcagggatagagtgctcaaatccgtgtatgtgcgcttcaggctaggacgtctcgatgatagatctgacttgtctctttttcgagaaactatctgatcgtctggtgttgggctgaggaaatgagaatcatctatagctgactcacgttcccctgagttatcaggcattaaacgttgatccccgcgggtggcgatggtcgacccacggaacgacttttcaaagatgttgtcggcttcgacctctgcaggcccagtaagaggcccgcgggaggctccaacttggcggcctgggctatccttatccaagacgtttgccttagacaacaagtcaaccatactttggatttcggtatcaccacttatgcgagcctgcgcattcacgatgccagggctgctcgcagcccatcccaaccgatccttcatgaaatcgatcgatctcttcagaatgttttgtcgagtttgaagtaactcttctgattgctgtgcgaaagagaacgagtgtagcgactcggacggaaaccggtgaaggtcttcgaaggcagggaaaggtgatcccgaagggaagtagactgaagcggctcgtgatgaggcgctggagcgtgaaggggaattcggcatattagagggagcaagagatgacgtggaagggtttggaagtgtgaagactcgggacaagggctgttggcgtatgcgatctagtccggatggcccaaggccaggatcgtgctcgagaagaggagatctgacggcgatgtaggagtcagcaagttactcattttttttagagccaagctgtcataccttgggaagtgttcatagtcagagaaagatgacccatccgtggacagcctcatctggttctgctcttccgtggaagggacggagagatttcccgcgctcttgttctttgaagcccatgatgtttggtccggtgaggccgagaaaggccccaatgggggcgacgagagagggctgagatctcctgttccctgaacgttagctagaatttcttcccgcagtcctctgtcgcgataagcgctgcgttatggaatgctaagaaaggtctcattccaatcattggtcccgatcctctcctatcttatcgcgcgaagacagacagagattggggaacgaagcccgccccgaaatctgtgcatagatggcatttgacgggaagagctctttcaagttcccctgatcttcatgtctgccaagcgcttctgactcaacgacaaaaacccttttgctagggggataacgggcgtcccaaacaaaattcgttgtgctagggctgaaagcaaaagaaaagtatgtccactgaccatcgttgtccttcgcacgtcctgtcattcttgtcggacgaaggtaaaataagcggccggcggaagacgaaccggaggagagctcgaggcagagctggttctaggcttgcagaagaggctctaagacggacatgagacaacgaggatcgatcgatcgatttaaccacggcgaagatacgtcgtgaaacggcgtctggctctattgtcgttcgaggaactggcgagggccaccagacaagggacgacaagtcaccggtctggtcactcgtcccgaatgggagtagtcacgggttgctgagcgaagcgggcagctgcctctggctgtctcgtcagagaaaacagggcatcgcggacggtcctgtgactcgcaacgagggttcgattcgatcaatgtggcgatattccaggtcgtggaggggcgaagagcgccaagcgtcacaaatccgtgggcggtgatggttttcttcacggccgggatggtcggatggaggtaacgacaggagcaatcacggacgagagacgctttggggccacagggcagaaatatgggattcttaggattggacgatgagttgtagggtagaattgcaatagtgttcttccggcagtgatgtaatttgacggtcgccgggcagaaacacggagtcgactctatggcagattaccgttggagcgtttggttaggcggagagttcacgcttgaccctttgcgggccacagtacgtccactgttgttgggctttgctgcttctaaggggcgttgttcggggcttcctggctcctgctgcagcctgctctgtggccggaggggtgggagttgacgaacacttttttcagcgcgcagtggctttattactaggggacgcagtgtggcacatgctgcgacttcgctctgttggtgagtggaacgcggttagatcggccacaccattgcccgccggtcgcccttggctgctgacgccgcaacgcctaagcttgagacacgcttacgagtgacgacgatcagttgatgctgattgacagcagcagtaatcactgggttcggcttggagatgttctgcaggttgcagcacagatggctggagggctgcggagacagtaggtatatagttacatatgtcactaagcatcgcgtgcatcgtctcgatttgaatttccatctaggtagtcggtcttcagcagaatttacaaaagtgtacaacgatgcttccctcttgctgaacaccttgagctcaaccagcgcccgggtaacgtcagctcctcgcggagattccacgccatcgcttcaaggaagagcaatgctaggaaacaacgatcccgaggccagatggggcggatccacaggccaagtcaaaaacgaacgcgcaccccacggcctgcgacagcaactggacgaagtgatgaggttatagaccgttggacgtgtctccggatctggaaacagcgatctgtgcgttctcggggacccaacttcaagtagtaactatctaggacacagcactacgaagggccgattgattcaagcaagtctttgttctctacccagctatatgcaacaaacgaaaacggcctagagacggcccatacgacaaacggcggtagttagctgctaccaccacgcaaactgctcaaagccaggccatcatcctccccagtagaacgtttacggctttcatttcgaccatcgccaaaaaggggactttgtttcgatcgggcatcgccatgcctactttgatctggaggcagggaggcagaactgataaaactggaccgattcgcgttgtcgccaagcatccaagagaattcggattccgccagggatgggcgtactgccggtcggtggggaactggaacaacagtttggggtttggaagtcgcagcgattccgtgttcacggattgtacggtcttctggcgttggggatggagctgcagccatctttgtggctttgctgtctgccaatggcgcttccacctcttgcttctcctctcgcctctccccttgctgcaagacttctgtttggccatcaatcgattcagtatccttggttgactcggcaggcgacgatgttggcgggctgtcaaggcttgtctggacagattggaccctctcgtatgcccgattgagcgcttcactagccttggagtcaagattcccggcactttcctttaccaggcgtaatcccgacaatgcatcttttagcatttcagctagtctcttgtcacgtttttcaagcaatactgcttttttggccagatcaacaggatcggagacttttaccggcgcgggttttggagagccaaagcgagggctgctatatcgagtccgcgatgttgctggactccctgaatctgagtaaatcatattccgcctcgcctcagttaccgctccgcggacagcctttgcaacgccccatgcctccgttcgacgttgcaggccttctgagacatcctggaatagggcttccaggcttttgtgattactccgtgcaggtgatcgaccaggagagctgtcctcacttgcattccttgaccttcccggcagagacttcgcatgttggaacggcacctttgcaagctcaggcggccgccctgagtattttgagataaggaaggcacctcgtgcgggactcaagttctgttcaagatataacccatcttgaactagagtctgtggcccgtgaggatggggagaaggatagcgtagtagtaacgccaatgctgaggagtaatctgcctccaagactgcaaggtacaattagcgattggcttctgcctgacacacttgacgctgcactcacgctgccaccgaatgcgaaggagcattgcaacacatatatagtcaatcaggtccagccgcaggccatctgcgaaaagaaggtcccagataagaaggacatcctcgaagggaaattcccgaccaaatagcaggcgtatccagcggctgaagaaagtcagcgtgggttcaagcacagcagttggacagtaacccacgtgaggaagatctgtggtaggatctcgattgcatgcaagtgagtcgccagctcacgatccgcagccatcaacagctcgtcgtggatgtgctggcagcggttcacaatgggagcgacgtcggtttgacccgtaaaagtcttttgatcactgtgttcatagtaggttcgagcgatctgcatgatgcagcagaataagctgaaagagtcgtgctcgatatacctggcatcgagcagctgcaacattagatcgtcgtatttgtcatctgcaccggctttctcgatagaggttctatcaatcgcgtctcgttccaccacccatagaacaggggccaacagctcgtgcattccctgcctgtatcccagatccgggttgagtttcgagtagatgaacaagatgtccagcatcatcgacttggtcgacggctcgcggaagaaatagttctcctgtaaacatcgttccacatcctgaaagatttccgctcttatcgcttcatcgcgtcggagggcttgccagggtgactgtccacagactcgcagtcagaattgcagtgaccctccgggctaataatatgacagatgcggtatacctcctcgtcctcggccaacgggtcgatcgcggactgcaggtcatccggatgttggatgtacttcaggaagtgctctcgaagcgctgagtaggcacttcgcgaatcggatatccgtggcagccatgccgaccggtcgaggccatcacagagtaagaaagcctgaccatcaatcaatccgtgagacccgaacttgtagaaattggtcaaaagaaaaatatatacagaccttccagcagaccgatctcaagccttcatcgcacggattgccctgttcttcggacttcagggctcgtttgaggtcgcttgctgattcgccgtaactaaagagcgtgtcccatttccgtctggagaaacaaaacgaaacgaaatattagtctttgaaacgcgcagcaaaattccgctgtgaaaaggaccgacctggcttcttcaatagttttcatggcatcataaatgcgcgaaaagcgacagccaagcgacaagtcccagtcaagttgatatctatcagaggatgtaggggcgccagatctggaagtcggggtgataacaaatgacgcgtgacccatgctaagttggtggcggggtactccggttgataattttaggtacagagtatggagtagtaagagtcattgaaagtagaattttataaatcctacttccataaatatatactagtatttctatggtaaattacagtcagagtaaatataattgccaaaatacagtgaagaaatagcattaaagtgtactgtatgtactgtacagtcacatgacgcacgcagtatgattggctctcttccttcaagccccccgagcgctcggaacgtttaacatccacgggatttgcagcaaggttccaatgtctgtcttctgtacatgcgctgtacggcggggaaagcatggcagacggccgcagtcccaatataatgtcgccaatatcatattatgtcgccatttacatctagatttgtcctcctcatgatctctagagactctgtgagctttcttcatccatcatgtctgcggatctgctggctgagtttggaaccggtgtgacttcatcatcgtcccgggcaagcaataataatcataataacaataacaataatagatcatcacagcaacagcaacaacaacacgccaagtcggcatttcctgatcttggtcttgagtcctttgggcctgtcgcgtccacaacgaacccctcgtataatcatggcccggtgagaaccagtggcggtgcaggaggaggaggtttatggcgtcgcgacgatcaaggagcagaggtgttatttgatgcatccacggaggacgtccctactggagacgacgatgacgactggggagagttcgagtctgcggatcccgttgctgataagaagttggtcgatgtagaggtggatgatgagccaaatccaaaaattccacccgcgtcgacgcacagcaccagttcaaagccgattaatacttcccaaacttctgctttactagacctactttcgctggatgatactccttcatccaccaacaaggctccagctacgtcggctccccaaagccaagcgcctgcgcaaactagttctacggcatctttcagagatcctatccttcaacaacggaacacatcgaccaaatcatcagatgaccaatttgatgacgattggggagactttgttgacggctttgaagagagtcgtccagccgcgcctggaccggcaggaaccgtcaaggcgaatcctccaagtcttactcggccaagtcaagtaaggcacaccgtggagtcggcgagcaaacctaacaatcagagctcaaagcctgaagtacgaccgacaaatatccctccgccatctattctactccagctgttcccgtcaatctttgaggaattccgcgaaggaggatacaaagctaagcatgatcctggatctaccgcctcggatttcgcaccccgtctggcgtccaccctgaaagtcgcggcccgcattattgctggtcgtgcattgcggtggaagagagatacgatattgagccagagcaccaagattggcccttcccggtccgggaaagcaggcggaatgaagctgagttcagtcagtaaaagcgaaagcgttaaggaggagcaggaggctgtcggggttatcgaagcctggcgtcgccacgccgcctttttcaactcagcaatcttgtcatcgggcgggcgtcccgtacctgtcgttaccgacaggatccgaatcgagactgcgggtccgagccagggagctctgacggcgcctcacgcatgtgctctctgcggattgaagcgcgatgaacggcttcccaagatcgacgagaatgtcgaggacagctttggggagtggtggactgagcactggggccatacggattgcaagcgcttctgggatgaaaattcgaaacgtctgcaacgacgatgatcttcttcagaacatagcattaacgattgcaagtgtatataaaacagtcatagaagcattggcattgtacaggtttacctcatgccattgccgtaagtaaaataatgtacatatagtcagatcgaagtacttctcctctccgatcacacatagataagatcggagaatgtggggtgtgcctcaggaagcggcaggaacttccctctttattcaacctcggcgactgaggtcgactttttgcccctcgggttctgctccgccctccccaaaccgtttgtttccctttggtcttgtcggctcgtcgatctaaccttactccgtacacccgtgatactaggaggaagcaatggcagtggctgtcccgatttccccgtctgtcaggatgttgtcgtatatcataccgaaaccccgcttttctccaattcccgccccctcatcgtggctctcgataataaatacgattgagaacttggtcaaatcgctgtgacggtgttgcatcgcagagagacccgtgcagagctctaccatccgcaatcgaatcagggccgtctgtgtatactatacagacgtcatatatatagctcccttaaccgaggactggctgacacttgattctgaaggaaaggatcaatccattggaaatactatcagaagagatatcaaaatggcaacagcagaaactatgcgcgccgtcgtcttccacggaccgtataaagttgccgtcgaggaacgacccgtgcccaagatccaggagccaacggatatcatcgtcaaggtgaaatatgcagctctttgcggcaggtatgcaatcccatcagtagtttatactcatttattttttttattgtttattaactattatctagtgaactccacgtcttccgtggccatcagccttcgaaaactgggttcatcatgggccatgaattcaccggcacggtggtcgaaaccggaagtgcagtcaagacggtgcagaagggcgacgtcatcgtcagtccgttcacggtgtcctggtatgaagaaccgtgtttgagcagaagccgttgtcaccaatgctgatcctcagtacatagtggcgaatgcttttactgcaagcgaggcttctcctctcgttgtgaaaagtgtctgctgttcggttgcccactgttagatggcggccaggcagactatgtacgtggccgtacctgtacctgcggcacgtttagaataccatctaattagaaataggtccgaatccctctcgccgatggaaccgtgaccaaagcccctgagggaattgatgagaaattgctggtcctgatggccgacattttccccacgggctactttgccgcgagcaacgcattcagggaattcaccaaggagcagatctccgaactgaccgtggtgctcatcggttgtggaccggtcggtctgttggccctgatcaatgcgttagaatacaagcccaagcacatcctggcggtggactcggtgccatcccgactggaacacgcccgatccctgggcgcggagccgtggaactaccagacagaccgggagggactcgacaagcgagtcaaagagctgacggatggccgcggcgccgatgtggtgattgaggttgttggcttgagtcctgctctgcgaatgggtttcgagctgctccggccgtgggggaccatcagcagtgttggcgttcacaacgcagaggtgagtgggccggagtcctgaacaaaaaaaaataaaaagacaagactgacagttcactttagataccctggaccggaaacgaggcctacgggaagaacctcaaaatccagatgggccgatgccctgtacgctccatcttcccgcaagcgttggaggtgctgaaaaagaagcagcacttgctggggtaagcatatatctgcaggttttgaatcatgcagaactaacacctgtcatcagattcatggccgataagatcatgcccctgagcgaggcggtcgagggctacgagatttttgacaagatgaaggcgcagaaggtgatttttgaagctggcaagtagtgtgtagaagccagccagcacggggaatctggcagacggacatgaaattgatgacgagaatgtgtactatgttgggctttgtatattcgaacgtatatactcgcatgtgagaggtgtacttcagttgagaatttacgtttggaagcagtcttgaaagccgtccttgtatttccatcctttgtttcgggtcgttgctaggttcgctcacacactactgcctagataggcagcatgaggtagtctaaatccttcgcatgtcctgcagatggcagtattcaacaccagcaatcctgatctccgccttcttcgccttatttccttcgcactcgatgcgtgacgaatcggaatgccttggctctgcaacactgagcatggaacagcgagaagcggggctggggccaatgaaggagctttccccagaacaagttaactcgcctggaatccgatggttggaggagcttgtcgtcgacacgctacgattatcagctaatcatcaaagccccctcgatcgggggaactggacggcgtgtcgtgtctgtctgcgtctgcagcgaaatgtgggtggcgggaagcgtggtcgcagccctaggcggccatcacgacgaccttcacaagagaataaatatagtagtgcatggcaatgccaatggcagatgccaattagttcgtcagtaaatcgatcaataataaccagcgccccggcaggtggtgcaggcagcccgcagcagcagctcaaccgccgtagccgtggggagtcgacctagtgtgtgctgctccatcctctgctctcgcgactcttcctcttcctctctcctcccttcacctctctctccatccaccccgtccatctcctccccctcctcctctccatcctgtccatcccatcctcttctcttctcttctcctctccttcctcttcctcttcctcttcctcgtcctcgtcctcgtcctctttcgagcacctacctctctccgcctccgccatcaccctcaccttcgtcctaccctccgctcaccgtacctcctcgtctccgctcctcgaccttctccctccactcttctctctccaccttccgattcctcatcgcgttattccggtaagctgctggcgttttgttttgccgtgcacccaaatccagcactgcgtgcaccgaatcgcgttgtcagctgactcgaatcgatcgccgccagctcaacagctaccctggagcttgtgttgatattcttgagtgctctctctgtcacgcttgatttcctcgacaatggctgcagccacggaaacccgcgagaacatcccgcccgcggacgagaagctcgccgattccttcagccgcgtcaacctgggcgaacaaggcgaagctgaggcgccgcccaagacagacgaggaatacgcgcaggcggtgctgacgctccgcgctattgtgtcatccaaggaggccggagtcatcatcggcaaggctggcaagaatgttgcggatctgcgcgaggagacgggcgtcaaagccggtgtcagcaaggtcgtccaaggcgtgcatgaccgcgtcttgacggtgacggggccgctgcaaggctgctcccgcgcctactcgattgtcgccaagggtctgctcgagggggccccgcagttggggatgggaggggtggttcaaaacaacgggactcaccgtgagtactgtctggccggttggttatatcaatcactaatcatgtcgtgaagccattcgactgctaatttctcacaaccaaatgggcaccatcatcgggcgacagggcctcaagatcaagcatatccaagacgtgtcgggcgtgcggatggtcgcccagaaggagatgcttccgcagtcgactgagcggattgtcgaggtgcaaggcacgcccgagggcatcgaaaaagcggtctgggagattggcaagtgcctcatcgatgactggcagcggggcacggggactgtgctgtacaatccggcagtgcgtgcgtctctgggcggtctcaaccacagcgctggaccctatggcagtcgctacaaccgcacgggcaacggggccgatttcagcgacccggccggaggctacaaccggcgcacggggtcggacgcgaaccggggcgttcccctggtgacggaggacggggaagaaatacagacgcagaacatcagcattccttcagacatggtggggtgtattatcggccgaggagggagcaagatcagcgagatccgtaggagctctggagctcggatctcgattgcgaaggcgccgcatgatgaaacgggcgaacgcatgtttacgatcatggggagcgctcaggcgaacgaaaaggcgttgtatctgctgtacgagaatcttgaggcggaaaagatgcgccggagccagcaagcaccggagtgagcgaatgcagtgatggattgcagaggtgcgattgcagcgttcagctttgcagtgattgcagtggttgcagcgattgcatcaattctttcgactacgactgcgtgcgccagcggtggtctggctgggttgaaggccgattttcttcgttcctgaaaacgggttatttcattgatttcattttatattgcttttattcctccgcggcgctcgatactagaagtttcgctcgacgcgaggtgcacgagttacgataccgagccatgcaagcatgcaatccatgtcaggtggacgttgcaggaacattactatcctcggttatttctgtagcaacgtcggcctttctcgttcttctatacgtcgcaccgatcatctcgtcggctgtcattctatcttctatcctacatctgctctgactctcacctcatctctatatccttgcttgcgccctatcctatgctatcctcctatcttatccttctatcttatccgcctgtcctattctacggttctacctatcctatcctattctacctatcctatcctactgtcctacctgactcgctgtcatccttttctgatgtgatatgtctggcagacggattatagtactacgtaaggctctcgggcaggaatacaaattgattcagatgagtgcagttgacgtaatctggtaaacttgagtgggcaccatagcacggcagaaacacaccccttactagtaactctatcatagtactccgtacggagtaactggcgtatatactacgtagttaattttttttttcccaggaaggatatattctatcctgtctgttcatgtcgttaacggatctttgtctttctttgtctttcctggcatgttattatttcattcatcatgaaatgtaatatattatcctctcttttttttttctgctttttacagacagacagacagacagacagatatggatatctaccccatcgattattaatcgtatctgtctggtttatctatctatctatctagttatatatttattacccgcagtacttacctacatacctaccttacctacttaatagtatatatatataatttgcagctgcgatattcgatgatggttagtcaggggtaagggagaaagttaatggtaatgataatattgtaacagcttccttgctaacatctagttacctagttaccttattttattccctcgtatgcatataatgtaggtaataaaataatgcttggatatctctctcgcctgtacagtacatacatacataacactgtagaccatgtatatgtacagtacagtacagtacagtccatacagatccaacaacacacagtcacagacacacacaaacacacgcaaaaactccaatccatcccttcctaatcaagtaatcaatcaatcaacaatgaaatagatacaagagtcaaaatcctatcctatccgctggatgtacatacaaacaaacaatgtcctggcaatgtgctgtgaaaaacccccatgtacagtaagtaagtagatagaagatcctgcaatgtatacaaacaaactccgtgtcgcccgtcgccgctcataaaacaaaaagaaccaagaatactgtatggatgcgtgtatgcaactgaatgcaaatgctatacgtcccccaccgccgtctgtcgcggtcgcagcccgaatcgtcgactccctaaactgttcgttcgcgcccgctgctggatcggcgtgtagctggttgccgtcttgctcgacggcgccacgatccgtgtctgcgatggctgtggtgattccccgttgggactctctgacgtcccccgctcagaccccgaatgcgccagcccgtatcgccggaatcctggctggatgttgacgcctgatgccgctgggatcccggttccccccggtgatgcatagcttcgtcgaagaggaatggacgatggcgttcgcgtcgtctgttgtgacggcgcttgagaggctggcgttcgagtcgacggcgacgacgactcggtcggtgatgcgtactcgcgagacagacgctcccgtgcagaccgcagtccagccgtcaaaccgccaacttcggacatggcccgcgaagggccaacgctccggctgaagacagaacccttgtcgtccgcttcctcctctcgctttgtccgaagagatgtcgacaggcggcttagtcgagagatcggcgtcgaggtctgcggcgaggacttttcatcctgcgacagtcgggctgcgttccgcgacgaccccagattcatcgtattcagacgagcttccagtcgactcggaacgcgcggcgcagactcttgctgctggctggattccggctcgtggctcatgctccggcgatacggcatcgccgtggacagcgtatcgccgccgtccgtctgagtctggttcgtccgtgacgacgcatcgcgactgactggccgcgcttgttgctgttgctgttgctgttgctgttgctgttgctgctgctgttgttgttgttgttgctgctgctgctgcctggccaactggtcatctgacaacgccagacagagctccgtcaggctgcgacacacgctgtcggctttccgccgcgcctggcgctccgacagggtcgatccgttgaccatcgatgccgttccggacgacgagcccgagcccagcatgttggctaacgtgagagcgtcggtcgcggtgacctcgagcgcgttgtagacttcggagctcaccgccgtcttggccttggccaaggcggaatgcaggagcgtctggatcgggttcaccgtcaccgtcggctccgggtcgggagacgtgctggtcttgcggttgtgtttcggggaggacgagatggtcgtcaccgtcgtcgcggcagtgcgaggccgctcggcggacgcattggacatggccgcggccgacgacggcgggaatttcccggtcagctcgagtttccggattctcgacttgaggtcgtcgagttcgtcccagacggtggacggcgcggtggtcgacaaggtcgattcggtgccgtccatgcgggacttgctgtccgcctcgcttctcgcgcgctccgtggcatcggacgggcgaatcgtgcgggtcgagctggacaggttggagtgtcggtaggggcggacatcggtgatggaggatcgcaggtcagcgtaggtgtgaggcgagtcgggcgaggtctcgcgactgaagcggctgcgcggcaggccgacggtggatcgggaactcgagaagtagcggagccggctgttctcatccagagacgtactgtaggagaagggcgacgtgtcctgcaacgggctgctctgggtctgctccttggcgagggaaatgcgagtcgacaggcctgagagccccagtctctgcaagggggggacaacatgtcagctcagcggaggaacgcatccacgacggcgtccaaactcacccgtctgcggtccaacttgcccgtggaatctcgccggctggcggtcgacttggcaatgttgaggaagacgtcttcgttcttggagcggctctcatcagcgctggaatcgcggttctcgtcgccgggctggtcgtcgagcgtgagggtgcggtcggggtcgtggacgccgttggcggcaccgccgtcggagtaggacgacatcctgcgggccagagcggatgcggcgggctggggggccagatacgtcgacgcacgctgtcgctggtcgctcttcaggccggcatcgaggcgcggggaggcggtcttgggcgagatgggcgtgagggcgggcaggtcaggggtgcacggggcaccgtggtggtgttctttttgtttggcgggcgacgtgtcgggcgagctggtcgacaggcggaacctgcgcagaggaatctcggccagcgcgggattcgacagggcatggacgctgagcgacgagcgcgagggcgacggcgagggcgacggtgagtgagagtgggagtgggagtgagagtgatcgcgggcgctggtctgggggcgctgcactgagcagtcggcggagcgtcgagcggcctgtcgcagcagctctgagggccgccgctcgacgtggatattgggctccgtctgtcgcctgggccgtccccagtcgggctcgctgctcgtcgccgtcgccagcatcatcgtcttgggacgcgccggggacgtggtctcgacacgcatcgggggtgctgagctctcgctatgcagcgctgcggcgcaggctcgtccgcgagggcagcaggcagtgatggaggtcagtgactatcagcagggtggcaaggacaggacagaggatcataaatgataaatcatgccgagctggtggcaggaggaatccgttcgtttcgtttgctggctctaatcagaagagacggtgtgcgagaccgcatccagcacgcgcctgggcggtgctagacgacgactagttggtgccagcaccagcacagcgactattagagtgcatacggagtacaatcagatctgcagtgcaatctaaatccaagaatacggtacagaatcctgtacaacagtcaggcaattcgtggtgcggacggtgccatcccacagccaccagaatttcgactgccgacggccaccgcacagcatccaccgactcgacggcaattccggagtcctttttcttcttgccaggttgtgtgcctgagccaaagaatggagcagcagaatggatcagtttcaggagttagcccgtttgaaagcggaatagaccgtcgtttgacgttggtctgtggggaggtttctgctgaaccgtggaagcctcgattcgagaaaaaattaagaaaggtgaaaaagaaaaaaaattgaataaaaaaaaagaaaagagaaagagaaaaacaagacgaaatgaaaaaaataaaaaaaaaagaagaaatgttgaattgaattaaaccatcgaatcgatcacggtagggagccgagtccacaatagtggcagtaattaatagtaatagtaatggactcgttgacctggacgcctcttctttctcacctggactattaagtcatctagatgtcataccaagcttccagcacgctttgtcagtccctgcatggttgacaatgctctttccacgtgcattccattacatctgatctccatgccacgcaaggagtcgagcaggcacatggctgcacggatcatccacatacttagcaggaaaggacacggagggccgtggcttttatgtcgattttcgtggcctttccggcctgatgttgccgctttacggtgacacccatgatggttttccacttttccaatattggctatcgcaatatatacccttgttcatagcgcctgagaagtatgtacaggcatcagtcggcgcttccatcgtgagtctcatctgtttaagcaggtatataaccaggcatatgggagtctggtaatgatttcaagggtacgtttctacttcaacttccaatcattgtggacctcatagtttgccatccaatcccattttccaactgtactttgttcagccaagatgattgttgttaaatccaggcgtcatgcaaaacagcactccaagggtcagactcttgaaaagacagatgaagcatgtgagtcttaccctaaaactatagaatattttctaagcatttctacagctggtgtgtggcaccctcactgaagagtatggcctcaacaagaatggtaaatttcagcctgtggttaatgttgacgacctactctaccttgtacaccattcaatggcaatctccgaagagggatttccaactccacggcagagacagcaacataatactctgcggaagatgatgacaagtacatcagctcgcccagggaccttacttgaaagctctgggtacttcaggtcaaacgatgccttaaaatggggtgatatccagttgttcatggtcaaagttcctgactatccctcgtgcaaggttttactcatgagatccaagcatcgcctcaacaaggggaagagaaacaaggggcttgcgtgagtttaagcctaatgtaggcaattcatgcatctatgagttgaagccgaagcacgctgagtctgatctctctacccctgtgtttgtacatagatagtccaaaaggagtgattttttcttcgtgcacgaaaggttcattacctctttttatttattctagtgtcatgcaaccaagtctgtactaatgtaagccaaccccactgatctctcgggctttgctgtccgcccgggcgtgatttcggcttggccataaacctttattccacgtgacaatacagtcgttaaggaaggctttagtttcatcccagattcctcgacaacagagagaaaaagcaaaattgataccatatccttcacatcgatcacagagtccatgttgacatatcgttgtaattatgacttcgaacccacgccaggttccacgcgatgtactgggtatcgcgccaaacatcttcatcggtagcttcactccactcctcccagtcaacaatgtagctgcaagtgaagcctctccgtcagcaaaccagttcaagccaagagaatgaggatatttaccatttctgcttttcacgatcccagacgaggtttcggataccacggtcttggtggactctgccacaggcaacgcattctcttaagaaccaagggtaatcagttagaatatcccatcttctcccaaccctttgcgataaaaaacatatggcctgcagaaatgcttgtaataacttactgccatgcttccttgaacgctctgcggagttgatcacgctcttcccttttcatgacgccggaccagtaacctgggcttgtccctggaagtttctccatcaaaatatagtctatatagccccccggtatccagtcgtcatcgccctgggtttcatgtttccaggcgaacaatgcaggcgttgatgaacaacctactgcagtcagatgttcaagggcgctgacctctctttgtgacgttaccctcatgtccggctctgcctgccttgccctaacaacctactgcagtcagatgttcaagggcgctgacctctctttgtgacgttaccctcatgtccggctctgcctgccttgccctcgcttgacgagacttgaatgctgtgctgaagtatggtatcctaaatgaaaccggttaggcgatgaaaaccgtgggcctaagaccagggaagcatactgcatccgaatcttaaccacagcctcttgggttggatcatcaatactcgaacacacaaagacaccgcgggcttcagaggccatcatacactccttgacatcagattcagtagcgcaatcttcactttcagcaagtttccggttgagcctccatcttgatgggtggggttccccaaacgtgacttcagatccgatccacctgtcttcatcgaaccaagtgactcccgaatgattgccgtccatcattgtcaacggggagatgagatgccatcaagcgacaaccgaaggcttgtgttgggctcaagaaaagattatgacgagcgcaagggatgcgattgcctcaatcttggcacatgctcaaaatcgactgtacttatgggtaggagttctcatttactaaccgccgaggaaactcatggggcggctgcgcagacctccatgggcggctaacctgagcaaaggcttgtaatcgcgctacgattggaccacctttaatctgtattttttagaaaagatgcccactaaaagccaactcagcgcatctagatccaaagggaagtgctaacagcacaacctgtttcatcttgaacctataggagcatgctggcaagagcgttgggttacttctcaatccagggtggtcgtctggtcgtttgagggagctgttatggctgttttgattgaacatggttgcacgtcgtgcatctgatagcgcagctctctgggcttcgtcagtgatattatatttagttcttagcttctataaagtcttccaagtgcgcctcttcaatctcgtttatctgtcatcctttcttgtcacactttctctcactacatatacacttgtattgcacattgaagcaccaaagttcttaatggctccctgtagtttgacaggaaaaactctcatccagcagcggatccctgacctgttaagcacagatcatcatactacatcgggttcaacccacaagcttggcttcgcgtcaacgttgggctattggtcccgattcgagcgagacgcgcgccagcacttcttatcggtcaactggaacagcaccattcttgactatgccccagatgatcatgatgacaactcatgtcatgtcaaaaatgagcaacttttctgcggggatgagcattctgtggttgcgcggtttggccagaatgttggtcacgtcatgacatcggtgatccgggcttgcaagggagccgacatccgtttcggagatttcaagtcagccgttcctcagtcaggtttcaccaaggtccccgacattgccatcatggatagcaaagcgagactgctttttgtggcgaagcaaaaacgccttggatgcatgacattgaaggaagcgtacaggaagcgcccggcgactttaggaaagatctcggtgggactcaacgaatattatgctttacccatctatcaaagtgctgacatactaccattgcttaggccagatagccagatacatgtatctgacccagagcaagtatggtttcctgacgacctacgaacaggcgatcttcttgaaacaggataagcatccaaccagaaaagggaggtgggttctttggcattctccggtaatcctgcatgatacgcagtcgcggggggtaccaggccctagtggtcgaggccaagatctgtcaaaccctgccctttatcgccagagggtctccctgagagagtgctttctttatttcattgatctggcctgcggtgagaaaactgccatgaacaccatgaaacttaatacctgggtcgtcggacaggacttcaaatttgaccagcatgactatgtctcagacgaatcccctagtagctcatcggaagaggatagttcaaagccatactcggcccagcgaggagacatttccactagtcgagcttcaacccataaacaggcccaagaattagcatcaatggctgacctagaaagcctcgctagtcggctgactctcggagacaaacctcaattacacagtgagcttccttggcaacgcggcggtgatgtgatggtacatttcagtgactcacagcagcgatggtactacaaggacagcagaggaattcgggtgtatgttgatttgtataaagaggagcgttcggatggtccgtccagagcctattttatccagggtggttatcgttatcgggtcaggcgtgacagagggaagcaacgggctaagtgaccattcaaaactaccagtttagaagagagatcacagcaggagatatggtcagtaacgcgaagacttcgacacttcatccaggattgctaaatagtccagatttccgtcattaatgccacgattcgcgatcagtggtgcaatttcaaaacaagcaaggattctgtacttcctaagttcttcagtatcgatttttcaggattttaccccgatgattgagtttcaggctataaatctgtcgtaaagttctacgcaaatacggccaatgtgtacctagttattcaaacaaatgtcagatatctgggaagtgaactcaaagaaattgctgaaaacgagagtagttgtaccttctccatatagtatttgttgtccttgattgtggtcgatataagactccaaagtgactccctgatggcgtactggaatacagttggcgacgaaggaacgggtaattcgtatctcaaacaaaggtggtgatgtttgtttgagcacagggaactaagacgtgatggcggtgaagccagtatacttgaagggagaaaggagactcgatggtgagctgtcacgtggacatttggaaattctgtcagtaaactgtacaccgccttatacaccgccttctggatctgaacaattgaatttcagtgtcgaggcttatcgaaggcacattttctgcacccaggcgatgcttaggcatagggttagggtaactctgctggccaagaggacctgaaagagattattagacagtcctaatggcgaacaacagcgagacttcccatcgcgaggcgcttacagcgcagacaacagcagtcggaagctgatttggcagacttacccccgtcgaatgaaagctttttgactctggaacattggaggactttgttcttgtggaaataggtagaatttccacaaggctgactcatcaaataaaggcacaagtcaggtctgtattgattttatgatggatcgcataagcaacttcgtgagccacttacctccggacttatgcagtaaatacggagtccgctggtcattgagagtaccttactcggtactccgtatccgtactctgtacggtggagcgggggcatactagccacgaaacaaaatcttcaatgctgacgatcaatattcttaacgtcactgctgtatccactgttaaggaataatcataactactctgcaattaagcttctggacaagaattcgtttctctttctcaccgaaattcaacttggcagatattcatccgagtccaacgatactgaagaaaggaccatccatctcatcattttcatcctttcatctgggagcccatttaagagtgaaagctgaccaagggcgcaaatctatgcccaaaagtgcagttaagtaatgcgccgattgaatagtcacgtggctagtcaaatctttctaggtacttctaggcataagaatgctaggtactgtttgatgattgctatgatcgctgaaatgactatcatggagggaaaaaaaagaaagaaaggggcattaccgagaacctccaaattgggtacctgccctaaaggacttgatgctcatgcgaccatgtaatttgtatgctttcttgttactccactttacctctcccaccccttcgttttttttttaaaaaaaaaaagaaaaaaaaaagtaagagaaaagtaaaaaaagaaaaatagaaaaataaaaagaaaaaaagtaacattaaaaacaagagaaaaaaataaaaataacaaccaagaactagttagataataagcccgaaaaagtaagcagccgttcccgtggcatggcgctcactatagtaatcgacatatgtagatcgtagcgcatcactggcagtatccacacatcatcactttatcttacatgcgctgaaaatcaacgagagagtccatacagtcatgagatagcaacagagcacaacacgttccagagctagtttctgttctgggcgacgaaggcattccacggctccttgtggggttcctgtcggaggtaggctcgcagctgggtctggggacggtgtctccttgaccggcggtgtgacgtatttgctggttggggtacttgattgatccatgagcctgcatggatgaagtcttcttctgatggagtcccaggaggatactggttgtgagtggtgttccagacgggagaaaaaggcctgaatgttatatagttagattgttggtcacgtgaatggtacatacatctgggatggatgggggtggataagaacatactcgtctgtttgcaggttcctttcctggtcgctgttctcgggagataacacagcatggtcaacgcttcctgagctcatctggctggtagtagacgtggtggaaggaggatctcccatagccataccggacgcgacctccttcctggtaggatagagggagctgttgacgttggtagacgaagagatcgtattgttggccatgacgatggacacaatgtctcagcgtatgtccaagattggtatgtgtaaggtcaataaatagaagagagagagtaaataagtttaagcaacaaacacaaggtatataatggttgagaaacacaatgacgaggaagagacaaaataagttgacaatcatgaagaaagaaccacatatttatattctcttccacccaggatgggaccaatgcgttggcattggcatcaaccggtgaccctagccgttccatcactcattgcttgattttttattggatacgttcagcatcagatcagatatacggatatgtattgactcaggtagctacctaggtaaggtacttggtgggcccccgggccaggggccatcttgcccgagaatcagtggatccatgtgcaactaacttaagatggttaggtacctaatgtccgtatgaaattgcaatctgacaaatggtcaatgcttccaggtgggagtcaaggtggatgcacgcagtggattcaatttcataaaaaatggccttttctcagtaattttaagaacagaagttttttttttcaatcactttttagtaccttagccttgaaagtagagatttttaatattaatattattgacctaatatttgtttaaaagagattactttcactaatcattgcacatgctatgcaatttcttttgcattaaagaaaaatgcactgaaatttactgtaatttcatttcaagtgaaaaaattgaaaagtttctgtcctaggctcaagggcaagatagcccaggtgtgggtggatctgtcgcggctgtggcctagcaggagcactccggctaactccgtatgacggagcagttggcgattatgtgtcccaaccacataatatgataatcatgttgctcccaagcgataatctgagccacagtccgccacctggcaatctaagacctggtaggtaccccatggagctggaggtggaaagcctgacctcctattcagcgaaccaataacattataagttattattcagctgattgataaccttatgccatacaaagtatcaacttagtcctcctaagtcgtctgcagccgccgtctgagttagtctttgcacttctactattactccacaggtacgggtcgattttgtctttcttctccgaagttattttttattactggagagacatcctgaattgataggatcggaaactgctgtatctaagaagctatgctaacagctttctttgggtcgtctcatgggactcttgccatgcagagtatcgagagaagaagatagagacaaccgagttccatccacaggctaattccatcaatgcaccagagctcaagcagttggtttgggttctggttttcttccgtagacaacgtagcttgtgacagtcagcagtcgtattcagcggggagtcaagaggaccagcgcgcttacactttgctgtagccatgcagagacttgtcccggagctgctccttgacaagtgccagatggatctttgccgcatcgggctcccatcccagaacttgcgtgtatacacgcagaccataagcatcaacagcatcaggattcccgacataggcccatcttccaagctcttttagtttgggtccttgggccatggcccgagtggcaccacatagacactttcagtaacatcttcaaatcctgtctccttgatccaatccttcaaattgggagcaatgttcatcttccttccagtcctgttcccggcttcatgtaggtttcgtaggtattgcatgtacggcgaatcatccttaagggtgctatcatcactccatgcccagacatcgatttcaacagcctcaaagtatccattgggctttaaatgattatatgccttgcgaatcaaccacttccagtccttgacactccctgcaagtgtccgggcatggatgaaatcgaagtagttttcatcatagatccaatctttctcgaaatcgtcaacaacgaactcgaggtttggaggaacccacgcaggctgaatgggactcaagtcattgccaataacacgcgctgaggggaattcgctggtaatccgtaagtaaaactgcgcaattctcttacggggagcagttttcctgactcagcgatatccattgcccagattcctgtgcccgtccccaagtccaggatcgcttgcggttgcttgatgggagcagcgaaaagttctccgtcaaggataagtaaaaaccttcagaggatcaataatcattggaaaacagcccgttgtaaaaggacgcgactcacatgtggtgcacctgtatttctagttagcagtcacttttcttgcggagaagcctgcctctatgataccaggtcaagacggtcctgctcagtatcatcattgggcattcttgttatcacagttagctaaacggtgtcgcgtgaacctggaaggctgcgggtgatggtacaagtattttcccttttcagttcatattgtcagcgagctggacaatatattgagacagagaccctacctggctataggcatggtagcgtcgtccattctcatactgataattcaacacacttgaggcgagagaagtagtatcggatcgtgccgcttcttcgtaggcactgaaatcatcctagagttcttggtgagaacgatttcggggaccaccggttaaaataaactcctacatcggcagcaattccttcagcggcgttgaaaaattgctcgccagcacgctgcggggtgttcgaggactgggccgtttctgccatgtttttctgtctttgaagtaaaagcaaaacaaagccgttgaagaatgcgatcgaggcccgtacgatggaatacagacgctccgaaatgcaggcttactgactcatgatgagaacaaattccgggtggggagccaacagctatttatcggctgaactgacagtaattaaccgccttcgatgcaacagaacccattggatgtgacgagcgtgcagatgcaagtcagtgaagcggagcacaaagtttctgagaacgtggctagaagcagttcatgtttgcctgccaaagagttattggctttatagcaggctgacagtgttgcttgcaagatctcattggctcatccccgctgcttctcatttggagattagcgcctcttcgagacttccaatcgtgccatcttccatcttcatcatggagaatccatgtagccgccttccacatatctcgcataatcaagcaagtctttggtatcctctatcaggccgctctttcaaggaaccaaaacttgcgagtgtttttttcccttcgcggaggagagtcgtgccgcaaagaaagttgtcaagctcgtgccaaaatcgatggagtgctgtagcgtgattcggaagcactgtcagatttccccgctaagcgatcgacgcaagcgaccagttctaggcaacgggctagtggggataacagaccagcgacgcaaaaaacaaaaagccgattggccattgatttgtaggtcatatccgacggagtacggaatgaattctccagacaagttcgagtatggattattaatttcaattgcagtcctgcaactaaaccagatgagcaatcgttagttgttttataaagtgatccctccatcgacggcttctgctgcgttttgcatacttcaagctgcttgcactcgagctctcctttccttccaaccttcgaaaggccaattgacacaaagtctaccaactgagaatacactgggagtagatgcgggcatcagatgagataccctatcttctccagcgaagaacccagtttccgttcacaacagaatcagccggccaaacgaccataggacaatgcttctatcaaggatcaagcaggatggcctgtcagttcttttgcatacaaacgctgagcggctcacctatctgcttcagcctcgaaacaggaagtggctgcagacatctcggaggtgcaaaggtgtgagaattgcttccatttcccaaaaagactgaagagaatgatggtaatcggtgtaggtgcgccaatatcggggttaccccttcatcgactggctcacatcaagtaataccgctgatgttgaaatagggaacaagatcgaatcagattggcttcaggaagggggatttcgtggggctgcctaaacatcgaatacaccactttctgcttcttgtcgactacatcttggattccgttgtcatggtcccgccattgacgacccccgccagggacgtacttagtttccacgacattgatttccagtcgctcttttgtgccgttgatcatgcagagaaaccactcccagggggcataggcatacatcgtcttcttttctgatttgtcgccaaagacgacttgatcgcgaacgtatccctcgttgcgacgatcacatactttttgacatcagacatagcaaatcatttcgagatgagatcaaccagccaaacggctcgcattcgtcgacttgagaaaccaatcacgggtcttgttgccatacttacgagtcaagatacatgtattcatgatgggagaaatgattccctggaaacctgtattcattccattaaaaatctggagatggcgccaaactagaatctggggtgagtctaggtaaaagtcgaagtgagactcatgtcatccgcacggagcaaaaactggggtattgaatgcagcaaccggcacctagaataactgcagttaccgttctgcaacatctgacgcctaacagcgagccggacaaatctaaaacttgacctgaaccacgccggcccgatgcagacagcgatgacctagatccaattaagaacgacgttctccataaggattgtgtcgagatgaccagaaactatctcgagagacttataatacctgaagatatgctgccgcagctcgaaacactgtattatcagacgtctttaaggtagttagttagcattagcgttgggtttgaaaatgataaacacatagcgttaccagtaaatggccatccatcgttttcagtgatatccagcctctcttccggatcaggtgactgaccgatcgtcttgtcggacaatgacaccagggtttacgaccatggctggtcagtctgttagtttaaagtctaggtaaacagtctcactatttgaatccactatctagtattatcctcatcctcatcgccttactgattattctctgtctgaagttgcatagcagcttttcttttactaggagcgctctggttctgacacagaggtcacaacgacggccatcgacaatataagactcctgagccacacgcgtcgcaaccaccccgaaaacgacgcgcagggactgccccggaagacgttaacgattttggtcccaattatccttcctctctcgaagattcagcgaggatggtcgtcgagatagagcgtggcaaggcgatgatagaaacgctgaacaaaataagcaacacgctggagcagagagagaaacgtgttgcagaacttgaggctcgggtggaggcactcacgcgagtcgtagagatgcagggggaactcttccaggatgtatcagagaagttagatacaattacggagctcatacgtgctcgcggaaaggaacccaactctcaagcgaactagctgatcaggctgaatcagagtatcgtgagcggatggagtattattaggaggagtgcctgagataccttactttcttccatggaagcaattgattgatcatgtgtcagccacgtgcggcgccaccgatcgagatctgggtcacgtgcgtaagttcccacgacatcagattcgttatcgcagccattgacccctggactgtagacttttagtcattgtgcgaccaagataaagtcaaaacctaatgtctgacatattcctctgacactgcgtaattcacaatattagttgtacgaccgctctgttgcccctgcgcgcatatcggtcgagtttcgatggaactacgcggcaaaattattccgtagatgagatgcggggattagaggcgtaggaatcgtccaatagaagatggtggactgtataccaagctcctgatggcagagtttcactggcgccgtgtgggcctagcgaacttggctacaatgcttgtcgtcgatcccccaccgaccccggagaaccagcagtctgtagacgaccgctctctcatcgactttttatcgagcccgatcagcgatcactgatgaattacacaggacgggctctctgaaggcatccctgtcagcaggcacggactgtgaaagggtcaatgtcatggacgagtgcgacccatctccctggtcgtcgccatcgccccggttcttatcaccatcatggccggccaggtggatctagcgctatctcagcagccaaaccacccccgactgcgcttgcgcaggtctggatcatacgctccacagatgctgccgccattgcaaccaccaatcatgtgcaaaacataatcaccgtcgttgttcgacgttgcaccggtccaagctgcagcgagatcagccagcaccaactccaaacggttgctactcacctgccgcattggtcgtggtgaatacccaaccagagtccctgcagcgtccggagttctccgcagttggtgtccctctctctagcactgctgtccttatcgcgctgctctgttttgacttcatcacatggttaccaattaatttactgacatgaccggcgtcgtctagtagggggtcattgcgcgcgtcgccgtcttgcatacataatagcccgctgcgtgcttcccgttctcccgctgagcagctctgcagaactgcgacttttctcttgccctttgcttgacaagacaagatggcgaccccagaagcagaggtcgagggagtggcgcgcgttgacgaaaagagctccagcgaccccgaaaaggtctactcactggagaagggcccccaggacgatgtcaaaaccggacaatcgcccgagctcctccccgactacgagaactcgagcgacgttgtcggcagcgccgatgatctggttacccacgtcatccaggtcgaggatgatccgagcatctacccctggaccttccgcatgctgttccttggtacgtgcaccctggatgtgcctagtatgagcagcgtggttctgacacgcgtcgcaggtgttggcctgtccgtcttcggtggcgtcctccaagagatcttctaccgcaggtcatctgcgtctcgcaggtctttttgaccgtcatcgcctatgtccttggtgagggcatggcgtatgccatccctcgtcgcggttggattggacgccttctgaacccggggccgtttaatgccaaggaacatgccgccattgccctgatggcctccgcggcatctcagtcggctttggccaccgaagcgctggccgtgcagcagctgtactacggcggctacccgagccatgcagccggtgtgttcatcactttgtcctcccaactcatcggatatggcattgccggcttgctccgtgacatcattgttcgcccgacaaagatgctctggccgatgaccctcccgatcagtagcttgctcgaatctctccacaagaacaagcagcaatccaaagcccggttgaaggttcctccaagagatcttctaccgcaggtcatctgcgtctcgcaggtctttttgaccgtcatcgcctatgtccttggtgagggcatggcgtatgccatccctcgtcgcggttggattggacgccttctgaaccggggccgtttaatgccaaggaacatgccgccattgccctgatggcctccgcggcatctcagtcggctttggccaccgaagcgctggccgtgcagcagctgtactacggcggctacccgagccatgcagccggtgtgttcatcactttgtcctcccaactcatcggatatggcattgccggcttgctccgtgacatcattgttcgcccgacaaagatgctctggccgatgaccctcccgatcagtagcttgctcgaatctctccacaagaacaagcagcaatccaaagcccggttgaaggttttctacattgtattcttcattttattcttctgggaaatcgttcctgaggtatgcagctcgatggaatggtggttgctactcatgctgacgtgtgtgcgactagtacattttccccgtgctggagggtgtgtccattttctgccttgcaaaccaacacagcctggtttttaccaacctattcggcggcgcttccggaaatgagggtcttggcttccgtaagtagcggttggaggatccctgctcggtgcaaaactaacaagcgtgctttcagtgtccgtgtcgttcgattggaattacattgcctcgctcggatctcctctgtggtacccgctgtatgcgttgaccaattcgttcatcggctacctgggatgcatcatcctcttcatgggaatctactacgggaatgtctggaattctcagaatttccccttcctctcccagctgttgttcaccaacaactcgaactccacgtactatgacacctacaaccagacgatgatcctgagcccggattttaccgtcgatgaggaggccctgaagcaatacggtgtgccttggctgactggaacgtacctggcaaacctcatcaccacgaacatgggcatcaccgcgacgctcacgcacatgtttctctggaactttgatgacatcaatagacactcgtagacccttatctcatgttttaaagtgttccggttgatgtcgttaatatattccatattgctgcggtcaggttcggggagatgttcaagaggataaactttggcaattttgacgacacggtcctcatcaatcttaagaattacgccagtcaatcctatgccaaccactggaagattatcgtaggggtcgcaggaaagctgctggctttggtttatcattctggagtattctgtctgagaaggttgaccatgttctcctgatgaaacaattgtcgtagtgtcctgggaaatacttagtgagaaattgggagtaaattgagcaatcttagtcttaccttgtgtggtgctatctcagcagtttctcccgcctcttcaatatctagcggtctccctttcacaactgggaaaaacagactaaaaaatccatggagaggatggtaaaagaagcggcatacggtcgacaatatcgaccagaaacatgactggatgaacgaggacatgtccgatgacttttagggtgatcaaaatggacttggctttaaatctgtcaggatatgttgcctttttgaatggaacaaatgatcaaagggctgaacgtcaagttcaggacgtgactaagcagttctattcacgtgctttggagacacccgagttgctattctattctaggatctagctcaggacaaacatgtcgccggttacaactcccagcgcattcttttttgtttctcgttctcaccttccacggaacgagcttgttaataatacacttaccacttcatggtccttctcctctatcgcggacctacgttgtcacggggatctcaacaataatctccagcattatagatactgccgttctcaaagacgccctcatatacggaactcatatcatccactacggttctagcatcaaggtggcctcagagtctgagtcgagggcttgcagctgtccaccggaatcaggctcaagctcctcgtcatctccagtaccgcgttggcttaatctctcgctgcctgcgcttccgaggcctttcttcctgcgctttgagcgggtgacacatcgaaggcttcaggaatcttggccttagagtcgattcaaatatttgcttttctaggagcgttttggcaacgtagcatatgctgtcgatattatgctctctgctaatatctgccagcgctggcttgttaatgtgcctagaaggtggcaaaacagcagacgaagacatcgggcttggagagcttgtataacttgagcaacttttggaaggagaatgaatggttggtcgtatctgattaatgctcctcgagatcgttggtctcgacaatgtcgaagatatcatggatgacggtgaaatagcagataaaggtgccgtagcagagttaggtagggcaaatgatataatctcaatgttaatacaggaggtgaaaatctaaaaccgcccacatgataacatcccgtgcgcgctcacccgagacacctggctgcggatcgtcacactaactatgtcttctatattgaactttgctgaacaattttttactaggtttacttatgttactaagaccatttttgataagaaggtcacagaacatgtttactatataggtagttacagataaggtgtttcacactatattctaatgacaaaaagtggattaggaagacccttattaaggaggatattattaagaacaagaaacgggctaagcatatgttcacacactgtgacttaactaatattattatttccatgtagaccaatgatgacccagtctttattcatgagcaatacagggttcaaatgacctttgctattttaatatactactactccagagcaagaattggggcctatattcctgatatgttaaaagcggatgatcagggactccaatataaggtatttattattatcctatactatttggcatgtctctgaacgactttaggacatcaaattatacctctattgcaggcctgatggcaaaaaggaaattttttctatcttagtcaaaaatgggtcaaaaataatcatgaccccataaatataatgtaggacatgctattccttgctcctaagcaaaaatcctgactagcctttctaggttttatgtagcaataagagaacatgggaagctttgcttcaatctggtcccctatctactaatgcttgcatttgcagataacacactttttagcttagataacattgaggtgctggacaacatggaacctgatggaaatgagcccattcggctgctgtggaagccatgcatttgaggtgaaccagttctttaggtggtcactcaagccggtagtatttcaagacatgctttaacttattattcttccattttagagaccgtttttcagtcaaagactatgcacggtctgcctattacctaagcaataggacttagttagggaaaagtaggaaataaaagataggtaagcaggtggtaggaaaacaaataaatcacaagtcaatgaatggtagtctgttttgttggcatctccagcagttcctctttgcaggtactgaacctgttctccttcctgttcctgctccaatttcgctccattgtattgttattacaaaagatctgagctgcaatggctgacaccagcagacccgttttcgtgttcgtccccggcgcctggcatctgccagaagccttcgatgccatccgggggctcatggcccagcgagggctcgagaccgaggccgtgaccttgacgtccgttggcgctgaaccgcccaccaaaggcctgcacagcgacattgcccatgtccactctgtgctccagcgcctggccgatgaggggcgacagatcgtcgtgattgtccactcgtacggcgggctggtcggtgctggagccgtggagggtctggaatatgctcgacgggctcagaacggccagaagggtggtgtcatcatgctggtctacatgaccgcctttgtcgtgccgaaggggaagagtctgaaggacatgctgggaggtcaatggctcccgtggatgaagttcaacgttcgttcttcaacacccacggcttctgcttctcgtcactgatatagaaaacagggcgattactcctattcctctgaagaggagaccgtcttctacagtgacctccctcccgaggagcagaagaaatggatcgccaagctcaagcacatctctgccgccgcgttcctggagcccgccacgcacgaaccctggcacgacctgccctgcatgtatctcttctgcgagaaggatcagggcctgccgattgcggtgcaggagcagttcgcgagcaggctgggcagcaactgcaccacgttccggtgccagggatcccactcgccgttcctgagcatgcccgagaaggtcattgagggattggaattggccgccaaagtgggtgcggaaaagagtggtgtgtcggtttgaagtatatagtccagcttgacgcatatatagtttcagctggtttcaccgtggaaagtgggggataaaaagggaatgaatatacccctttttgtttatacccaagaaagatacctgtgtatgtgcatagataggaatgaataagtacgaatatgaatatctgcctaaaggctacctgaggtacctagggagtgagagtaggaatatttattttatatatacagcataaccgggtatctcatcataaattgggaaatggaccaggcaaatgggggtaatcctgtgacagacttgttctcccttgttaccatgttttctttccttttctttttattttttcatttttttgcccgtcttctttttttttttctcaatcttcatccatcgactcccatccatctctctctccatccgcaccatcttctccctgctcgccctctccctctccctcttcctcctcatcatcagatgagtcactgtcatcctcagcaactcccaccgtcctctcctgcacttcgccaccctctccggccgccgtcgccggcaagcgaccagcaaaagtccggcgcaccgccgcattggtcgacgtgtcccacacctgaaccactcccttactgcccgccaccgccagccggaagctcacctctgggtcgggcgcgaacgtggtcgagaagaccttgcccacgtcgagcttgcgcgagaccaccatgctgggcttgttgtcctgcacgttccacagcttgacctgcttgtccgtcgatcccgtgaccaggtcccaaatctcgatatccggatccatcgttcccaccgcgacaaagttcccggtcgtgcgaccctccgaactccggccgacgggcaggtctaaccactccagacagagcgggatggcggggagcatgatgtcgtggtggacgtagatgttgtcggcctcgtcctcgtagacgtagacctcgaggtgcgcgacctcgtcttcgaccttgcctgcgagcccaaaaatgcataccataacgccgtccagatgagatagataaatcgagtccagctcgtgcaggctcattccgcggcgtcacccttggcatcaggagcggaagctgccgaaccctctgccccggctgtctcagcagtagtaggactattattactcctactatctcctttagttttagagtgcttgtgtcgtctcttccgcttcgacttcgtcgtcgactcggcctccgagcccgtcccatgtgcagtcgtcccgccttcggcattttcactcatcttctgcatcttctgcttcctcccttgatcctccggtcgccgtttctccctcttcttgggcttcttcacgctcagcgggttcggtcccttggccttcttgaggccgcgctgcctcggctgctcgtcttcctctctcttccgcttcccgccagcggcgttcagcgcgccctccacgcccgtcttgaacttgcccttctccaccccgagtcgcaccttctccgagggcacgctcatcggctccaggatcatgacggagcgcttcacgtagatgatgggtacaccggggatggagcgcgccccggctcggagagcgctggcgtgtttgttcagctccgcctgcaagtcctcggtccgtttccgcttcttcgggttcgcggagtcgctgttttgtgtcgtcatcgtcgtcgcttccaccgacggcgggtcggccgtggcgagggtgtagtgttccttgttgcgcatggtctccttgttcgggcagagcagggacaggagacactcgacttcgtcgatcggagtatcttcttcattgtgcgagcagtgtcggaggggaagagtggtcggcggatggaggtgctcaggacggacggggttgttcgtcttggggttgatcggctgattagccatgatcgccgcgagggagcattttgacaaaactgtataaagcgcctcgacagatgaagaaagatcagatctcaactacggaggagttttccttcaatgttgaactagaaatgtcgaatatgtgatcaaaattctgtcagttactctatgtacatgtctgcttcagtgtcccatgcaatccctcatgtcaatgacagtatgggccattaatttgacttaagaacaggatgacgagactaaaagatgaggctggagacaatcgtcgatagaatcatggaatctggactgctataagcccaaatcctagggtcgagctgattccacctgcttgttcggatagccgtctgcttcacagcggagatcgcctcgatcctagaacccccatcggacacctggactgtactgtcgctatcagaggcgactgcactaccagaaatactatccagcgccgtcattgttaaccaaacccatatctgccatgggtgttgggccttctcgatgcgatgccccttcaaggtcacctaaatgtaggacgatcaggtcaacgctatctaggggcatcagcggtattgtaataagcctaacttccggaactttcccgggaggttggcagtcagatctgtgaatatgatatgtttctaccacgtcaaggcgaaaaatgtcacttcgaggcgcgcgtcgatcatttcccgtgaccttctgtcagagaattcgaacatgagaccgtcaccatacacgaattgtcttaggaattgcctaatcaggtaatcgtacagcgctccgaaacactcccagtctcatgattccaaataatatatcaaattactaggagaattggacctccgagaggtctataagaagagcgatatttccatagtttaggcagcgggaatgaccagagttcgttctcatgagatcttgatttatcatccggataatcatccggatagcctagagaaattccaacattatctaatcctagaatgactcacatggtcagccagtctttacggtcaagtctcccctgtggttagggcctgcaggcagccagtaagttccgccactacatttttgatttaacacaatatcctaccattgggatgggacagcgcccctgagacacgatctgagaaaacgatttgtatgacggcggcaggcaagggcgcgaggttcggtggtcacgtggcaacgcttgcttggaaggtgaagttaggcggtgagaggataatacaggcagaattcccccacaagagaactatcgaggcaacccggttccttgctcctctttctcctccctagcctagtcttttgtatttatgaccgctccctagtaatacgaaggcttctactattggatttgggtccgtcacaatttggttttatgtattctgatgagcaagttgtgttaaaacgaaagctcttccaacacggtgggagtcctgggaaggagacaacgtatccttgaaagcagatcagatccgcgcagctcggcgttggcgagaaattgcgtccataggggatgggaaatgtcatagttgtcctctgaactactctttggaggaagttgagaagtgtttaaagcttgaagctttgtctcaggcatgccccacacttgcttctggctgaactcctgatgaacttctttctgccatttgtatcatagctgctggcgggtgttgctggtgcagtgagaagccatcaacagttatcgcaacaagccacagggtgcatcgcgagaagtgagacggcatcgaccgtcaggccgggagacagtgggaagaagagaagatcgaggggcgtcggccgtcggggggacgcaccnggggtttatatagatgggcgggctccgcaggagcgggcaaaagcggccagggccggcgctaccccccaaacaggtcacatcggccctgtctaagcctgatcgggcaatcagatcaccctcgggggcaggcggtgaggggcggcagatggaccgtgcaatggcggccgtttccggcgccccgctaaccgtctcatcgtatacttattacttctttttatttgattgaaaaaaaaggttaaaaaaaaggtactctggagtaatatttagtgcaggtggatctttctattgttttctattgtttgttcagtccaaccacattattttttctatcatcgaattaattaattaattaattcctcgacatggattgataataaacaatagatggcatagtatggctgatctacatacataaatacatacatatctgtgtattcaagttagactttgtagatttcgtcaatcaccagtgcttacacacgtaaaatatttatattttcgttggagattttaatctagcaagacaatcaagtggataatgtaatatatttgactctcatttaagaacaagtcaatttaatccagctgaaacgaaaatcatatcaaacggaatatacagggtatccacctcgcctagggccacaacatgcaagagacaaagaagaaaaaaattataagttcataagagtgggaaatgtttacaggacagccacctgcgaaagttgccgcgttccatagtgtatcgatgttgcagggttatatataaccaagacatcgataaagttgatgactcgtgagtagaaggaatgacgatgttaggatctgtttatttgttgccgttcaaatacttctctggaatcttgggaacggcaggtggctccgctggagtctcgtcgtcctcttcgtcgtccatctcatcgagatccacctgtttactaagcgaatcatcagcaaggtccagtatgcacgacccaaaacgatcacttaccccaaaagctccttgatgtttttcatctcgtagtgcttcttccgccgctcctcaaactgacggtgcttctccttggcttcctcactcgtcatcagacgctctccctcctcatcaccgccggagatgctttcgttatccaccataacgtgcttctcgcgaaagatcctcttctcctcgccctggtcggctgcctggaaatcctcctccggttcaccgagctccaggctagggatgtcactttcgcgctcaatcttgttctttttacgtgcgccatccaccttgtcgagttcatcgacgaccaggtcttgcgcatccagcatccgcttctgggcctctccttctatgtcgtcctcatcctcgtcttgtgacgggtcatagcggggcacatagggcgtctttggctcgtcaatcttcatcttggccgttttctcctgttcggtcaggtagagattggcctcgtcccacttcagccgctgggggtgctcgtcctgcccggtagcgctcgaacccgacaggcgtcgggaagtcgaggtgcgacgggcactcgacgagcggcggcggccggcattctggagggtattctggagggtgagttctttgttgtcaacagagtccacaggcagtggttggggggtttcgtcggacccctgtgcgttaagggcgactttcgaaggtgcgttcttcaagatgcctacaaatcatcagccttaacttcctcgacccgcttcaacagtgtctaatgtgcatctgcttcacacaccctttggcttcttgggcgcttcgcctgcactgggcggctcgtgggagacggtcatggcggcggatgactgcggggcacaagaaaaagcaacacaaaggtgtatgcttggaaaggtggcaatcggctggggcttaatacatagcaccaggcccggcagaaactggtccagttgcagggcgagggtatctcacagcactgacgactgcctggcggtgtcgaggctagccagcggtccggtgggattcgggctgaagagctgaagacggctgggttgcaaagccagaaaagcgcgaatccacgctaccagcagattgcaggcgtgtcggagtgatttatcgtcagggtgctcacgagagaagcgagatcgagcgacaggacatatgccggacacggagatggaagggtggcgagttctttttgcttgttctctttctttctggctgttcctggccctcacgtggggtcgctgccgttgggcgggtgatgacgtcgatcgagcccaaccacagacaggccagatcgcgataggcagagccaccgctccaccgctggatgggagaggtttccaccctcaagtcgcttatgaaggaccgcctgtgggcctgagcatcatacggagtagcgatggcaatgtgtacctctcacgtgactgtgtagatggaactgattattctaattctaccactgaaagaattgctgctgctttctgctgtggtcgaaatgcctgtataaagcaggggacttgtcgatctgatcaaaggcgattccgatatctgcagctgcacaaggtgagtcgattaggtcatttatatagaaatatataaataaaaagaaaatcaagatgaaaagagaaaaaaaaatatcattccggttcgatcagggacctctattggagaagtcatacaatagtcactatacaactcataacaaaccctatatattcaaccgaaacaagtaataatgacaacaacagtagataaggactggtacacgtacattgcacacaagaaggcagtcactagaatgacaaaaaagaaagagtttggcctgtaaggcttgtatactagggaagcagttcactaaattgactaccactaactagttcagctagagcattccgccatcgtccgccgcaattgcgttttcaacgtccatatcgacggaacaaacaagatgaatggcattatccaataatctcgccaagctcttcgttagagccagtgacttgatccctatgcggctaatacagatatcaaccttggcggattaatcatttcatcccgcagagagagcctctcgcacgccgccagatacaagacccgtcatgatggtagtcagaaactatcaatatccaacgccctgattgaaggaaaaattcgcaagctcgaatccgatctatcgacatagtgcattatgaggacaggactccgcaggactccgatcctttatatctggaacttattatttacatattcatgatggaaagaactcacagtcaacagaaaatatcccccccggcctttattcgatttgatgtgagactggcacaatgggaaaaatccccaagttctccaatgtccacctcatcacggggctggccaccatcggtggcttgatccaagggttcgacgtgtccagcatgtctgccatcattggtacgaagcaggtaagtaagaagttattatcccagagaaataaataaatatcgagccctgaccgatccagtacaaatcctacttccacaatccgaattccgtgctgcagggtggaatcactgccagcatggccggcggctccctgctgggctccatcttttccaccttcatcagcgaccggttcggtcggagggattcgctcttcgttgcctgcgtcatttggatcatcgggtcgaccttgatgtgtgcggttcagaatgttgccatgttgattgtttcgcgcatgatcaatggctttgctgtgggtatttttaccagtcaggggtatatatatatctatcaactatataccatgaatttttgatttcccatattgatcgtggaatttgcagtcctattctcattgcggagattagtctgcctcgttctcgtggtcgactgatctcttttcagcaatggatgatcacctggggggtaggcgtgcatccagtgcggtgaaaaaaacattgttcgagagtcctaacacaatgacaggtcctgattatgtactatgtgacctacggaacttctttcctcaagggaaatatctccttccggcttccctggggcctgcagatgattccggcagtggttctccttgcgtgtctgccttttatcccacgctctcctcgttggctggccagtaaggacaggtgggacgaggcgattgagattctcgccaatctccatgcccggggcaacaaattggatcccattgttgttgcacaggtccgcgagatccaggagaaaatcgagtaagtcggccattgctggaatacgacacactctgacgaaagtgcttgcatcaatatgtaggctggaacgccagaacaaagacctgtcatggctcgagctgttcaagccacgcaatgttgttcgcgtccactgcgccattttcacccatatatggtcgcaatataccggcacgaacgccatgatgtattacatcgtgtatatcttccagatggccggtctgacgggcaacgccacccttctggcggcttcgatccagtatgtcatcagcgttgggatgacgattccggcactgctgttcatcgacagatggcctcgccgccgcttgatgatgacgggctcttttctcatggccgtgctgctcttcacggaagctgggctcatggcatcctacggccatgccgttccaggaggcttgaacggcgtctcgtccgttacgtggcaggtcacaaatccgcgagcgtcgaaggcaatcatcgcgtgttcgtacttgttcattgctgcatatgcaccaacatgggggtcagtatcgaaggcaggagtctcagtgatggcacacttgctaacacttctctcgtgtataggcctgcgggatggtaattcttgcatatctgatcttctcaaccagcttcactgctaatactgtcgtcaggctctatcctgccgaaatcattcccctgtacattcgcagcaaggccgtgtccttggcgacagcattcaactgggctgggaacttttccctcacattcttcacgcctcctggtttcgagaatatccaatggaaggtgtgtaaatgagcatggaggctggttgttttgaaacagcttaatggtggtggctgactctggatcggcaggtgtactgtatcttcggcacgttctgcctctccgccctgatccacgtgttccttctattccaggaaaccctgggcaagtcactggaggagatggacgacattttcaacaacgagtccatctgggcgttcaaggtccggaacaaaccgagccggttcgaagcggtcgttgagactgccaagaaggagcttattggagcaggtgaaggaggtgttgaggccaacaggattggggatttgccaaagtcagtgccggtgtgagatgtatctcactgaatcaatcttgtcaggcactcatttcttgtctggaccgtttgatagtggtagcccattctccaaacccaaggtcccggtcttaggatagaatatcgccattctcttaattaagtaatcttccttccacttttggtaagctctgacaggatgtgttccaaggcagatgagaatagcaagaaacagcactgaggttcgcatacaagacaaggatgttgcactacagcatgtcaacgccgatccctgaaccttaattcgacatcaaagattattatccaggaccgtggtgtacagtcaatgagtctaactggctaccaagtcatgatttgtttcggaacttgtgacaggtcaggccaggcaggacaggaacatcgttattccagcgtggcctgactgactcgtgttccaggaaggagagacggaatttcctagtgtggcacctgatactgcagtgtctgctgattggtcagcagccactaacctagtttaggcattcgcaggctgacaatacggagtatgtacggagtaactatctcttcccgccgactcgacccatgtgctatactgctttatatatcgcctttggcttctttctacaaaataaatagtagtatggtccacagataactggaacctgtgggggaatgcttgcttatcctctgtcgagactagcagttgttttgagttcatgcaaggaggttcgtagatccgtttcaggaatttatctcccgccatggttaagcttttctattggccttgtctgggccaggtcaacaccagtattacacttgtttcgagagtctcgcggccagaatcggggaaggcgtgccgagtgtttggaaccagatttatacaagtgactggcaatatgtcatcaacagccttctacggagaactgactgttgatcgattgttcatgcccggtctagtgattgctagatacctggcgctccttgcatggtggcatagttatcaatcaattgggaaagacaacgtagtaatcagtgagctgaataatccagatcgtctagaagacaggaatgttagcaagtgcatacctgaggtcgctgctggcggacttgacacctcatcaggggcacagatggacgcccgccattgggtctggcagcccccctggaagcacagacagctggccacgccgcgactggaagaggactagccgtctcacgtgaggagccaggccccgtcacggctgacccgctgctgccccaagctcccctgagcttatgaggagatcaatctatttcttatttatctccgtctcccagggtctgcgccgcgcctcctaactctccccctacatcctgtcctcctgagacgcggcatccctcatcgcaccactaagcgcattgcctgactgctgtcctgacatcagcagctgttgtgaccatcgtaagctatcccctgactgttttctctccttatcgcagagcggttcgctggctatttctcgcccctgtgtaacacccataccttcctgcacagtcgcttttcattccctttttatcgctagtaacgtgtcagctaactcctgcttcgatcgcagataaacagtaccaaattctattactgaaccatgtcagcagagcctgccgcccaggaaacgcctcaggcggtccctgaggcacagaccgccgagaagacggtcgcatctgtgtctgaggtgaagcctgaagagaaaccggaagagaagccggaggagaagccggaggagaagcctgccgaaactacccaggagcagcctgctgaggccacgaccactgccaatggctctgaaaccgctcctaaggatgaaccagcgcccaagaaggacgagagcgcggcgaccgcgaagcccgagtttctgaccaaaaaccccgccctgagccagttcttcgaccgtcttcctgccattctcgaaaagaccggccacacggagatgtggggtgttcctctgaaggacttcaacgacccgcccacggccaacgtcctgatcaagttccttcgcgccaacgagggtaatgtcaagcaggccgaggagcagttgaccaaggccctggagtggcggaagaagttgaatcctttggacttggtcgaaaacgcccgcttcagtgccaagaagtttggtggtctgggatacatcaccacctacaacgaccccaaacacggaaaagtgatcatcaactggaacatttatggcgcggtcaaggacattaacaagacgtttggtgacttcgattcgtaagttgttctccagatgcaccctatgagaataccctgtcgctgactgtcaacaggtttctcaaatggcgtgtcgctctgatggagctggcggtcaaggaactgaagctggaagaggcgacttcggtcattgactacaacggcgaagacccctaccaaatgattcaggttcacgactatcagaacctgagcttcctgcgtctgaacccgaccattcgcaacgcttcgaaacagaccattgatattttctctacggcgtaccccgaactcctccgggagaagttcttcgtaaatgttcctgccattatgggttggatgttcgcggccatgaaggtgttcctcagcaagaacaccatccgcaaattccacccgatcaccaacggggcaaacctcgctcgcgaattctcgttcggtgacgagctgcccaagacatatggtggcaaagctcccgaactgaaggagagtggccgaacggttccacttgaagatgacactgctgagccagccaaggaggaggaacctgcgaaagagtcaactaaggaagaggccaaggaagaaactcccaaggaggaaacttccaaggaggaagctccgaaagaggaggctgccaaagaagagcccgcgaaagcggaaccggccaaggaggagcctgcgccggccaccgaagccaaggacggacctgccaaagaggagccgagcaaggaggagccggtcaaagaggagccagcaaaagaagagccagctaaggaggaaccagccaaggacgaacctgcaaaagatgaatcggctaaagaaccggccaaggaggagccggcccaaaccgagtctgcagctgccgaggctgctcctgagaccaaatgagctcttgaatggctcgttgtcagtgctattgagatacccgatccttcgaatggaggactgcaaggatgcttggttcgatgatgttttgtttcggtgtctgatcttccactaccggagactaatttgcggacatgtggtagctaatgtggtacgtgaattgtgactggtcgaccactcaccttgcggctcaggaaacgatcagttgatttgataccccggatggattgcagcgttgtgcatgctttgaagatgttgggtttccaagaatgtttgtagacaataccacattgctattagtaggatattgggagggaaaacaatataattatacttaatactattcactttagaaagcccctgagatagataaaaggtaataaatattcagcagacttaatctcagttgacattggtgaagctcatcccggttggaacacacctacctattccttgaatcctacaaataccactagtattaatctgtacggagaagtttcaacagcatgatctcgataccttctccatgtggcattgccgcatggatcccattgatcaacaagagagagcatgggccctgccgatcacggccaagccagccaaagtcaatcaacaaggttcgaacgatactctcccataagtttaatattaaattaatattaattaacacggactaatgatgatcgagtcgtgaattaattaaggttgaggaggacttacttatcttggtaggtaggttaggtaggtaggtaattaattaaaggaagacgcttggatgcaggaaattattaaactctatgctctatacggagtacttcgtccagctgactatctatatatcgatctccctgtttgttgtcgctttttgctatatccctatttggatagtcatttttacggacatgtcagtgttaagatagccagtcagtttcttagccgagtatagctaataatatagggagtaatagcggacattattttgtctttgcttttttttttcggtttttgatctctctccagctgtatgctgtatctagagcagggatatttgatttcctatggcgggccggcctcaatttcaaggcctactgagacgggaagaaaagtagagatgggtaggacaggaccctgcaaaatacgactgtggaagaatttctgacgttctcacatagttggtaactgaagaataattagcagtttattcttgaaatcaattgtacggtcgactctgcagacgtatttcagagtataagacgcgcaatactattggtgggatgttgggcggtacggggaggcagaatccctcgagatgcactgcagctttccatcgccgccgacttcagttcgatggatacggagctgtctgaccaagctgtgagtgaaccaaccatcagaacttcactggggctgaagacttctcttgtcctcacagagagccatatcgccagttcacatctgtgagcgtttcgtcgtttccctctagttctgtcagcatgcctcttgtcttcctccagccttttttctgattgtcctcccgcatctttgacctgtttgccttcccacttccctgaaacgctctctgaagaggtttacacggaaaaaagagtattttctgtgacttgtctacttgacgatcacctttctatcggctcaccatgtccgtctggaatccggacaatatccgcgacgtcgccgagtcggtcggcattgccaacctcaacaacgacgtggcggacaatctcgcccgcgatgtcgagtaccgcatcgcgcaggtgctggaggaggcgctcaagttcatgcgacacggtcgacgcaccgtgctgacgacccaggatatctcgaatgctctccgggtgctggacgtcgagccgctgtacgggtacgagtcgacgcggccactccgcttcggagaggcttcgttgggtccaggacagcccctattctatgtcgaggacgaggaggtcgattttgagaagctgatcaatgccccgctgccgaagatcccgagggaggttacttttactggtaggtttccatactctagagccttttttttaaggggtggtactgagattggccatcgaacagcacactggctagccgtcgaaggcgtacaaccctccatcccgcagaatcctacgtcggctgagtcgcgcaatcttgaactggtgtcgaagggcccgaatgcgaaccccaccttggcggcgatgagcgggaaccagaacgtggccgtgaagcctttggtgaagcacgtcctgtccaaggagttacagctctactttgagaaagtgtgcaacgcgtttctggacgagtcgagcgaggaataccggacgtcggcgtactccagcctgcgggaggaccccggcctgcaccagctcgtgccgtatttcgtgcagtttatttccgagaaggtgacacacagcttgaaggacatctttgtcttgagtcaggtgatgcgcatgaccgaggcattgatcctgaacaagtccctttacgtggatccatatgtaagtgggctcttcgacgccatccggattgtaaactgaccctctaccttcccaggttgcctccttagtccctccagtcctgacgtgcctcatcggacgccagctcggaggcaatgctgacctctctgagcagtttgcactacgggacttcgcggcatcgcttatcggcctgatagctaagaagtactcccatgcgtctcatacgctcaagccaagactggcacggtcgtgtttgaagaacttcttggatccggccaaaccattcgggacgcactacggtgctatcattggtctgcatgctgttggaggccccgacgtcgtgcgggagcttatcctgccgaatctgaagccgtacgagaagctcttgagagatgcgattgcggaagacggcccacgacggcctgaggccgagaaggtcctgggtgcgctgctcgccgtgctgtccactttacacgagggacgcgcgcatatggccaatggacacgctgccatcgtcacggacgagctgcgagagcaactgaacgagaaggttggggagctgatcgcggcgaagattgccgaggcaggcgacgtccaaacggcccacgccatccttggccattaaaaaccagctgtgatgaatcacgctgtgtactgtgtactatgtatttgcagagccggccatggcacggttggtggtctgcacagaggcttactcattacgggcgtttcgggtgagactggtacggcatgattaagactgacaacgtgggcgtctgtgttttgttcgtgggaagtctcctggtggttaatttctttttttttcttcttctcttttttcttgtgatccatttgacagtacatgtagtgataccctgcaggatcatgctcaaaaaatccatgaaaataaatgcaatgtcagatagagtctcataactctttctagaaaaaacgaatcatgctttagatctgctctatcagtataataatagtatcttgagcgatttctcggacggcggatccggtgcctggcccaacgacgtcactgttctgctgcccgacggcacgagagcctctggttggctgaggcggtcaccgctcccactgtcgcacgacacctgtttccgctgcctgcgctatttcctcgcttctcgccctgccagcgctctgctctttgtctccttgcttgccactgctcgatactctgctctgcaacattggctgtgtgtatcgtttctgtcgtctattcccctggaaaaccctctcgctgcggatctgttcgagcccagctgagagccgcgttccgccgttccccacgcagctgttcaaactttgcagctgcacgccaggcactaaccactctccctcccccgcgattaattaagcactcaatcgatttttcgcccaacccacacaacaccgacagacgagggaccggccctaattgactcacgcacccacgtctgctcgctctcaaaattcttttcttcgcttctgtctgctcaattcatctctgtgcctcgtcctgcgctcttctttcgccgtcagcaattcgcacacccagaaaaaaaaatctctctcggctttgctacgcgtgaggattccacagccctggcgtctccgtccatgtgttaaacaccgtggcctcgtgctgcgcccgcctctttgtgaatagagacgcctcctgtcctccatgagccgaaaggaccttctgcgtttcctgtccaagcctgcgaagtgagtccttctctctgcctgccgtcctcacaaggtggtgatgtcgtgacgtcctagtccatgactcctacctcggaatgtcgactggttctgattgttttgtttcgtgacaggcccagataatacccgctcgtgtttttcaccaccaattcgaactctttgaatcgtcttttttctttttttttatttgtgtgcagcagatatcctcgtctgctagacccgatactttgaccggtatcggtatctgccagcgcgaggttcttttaaactagccaccatttcctcgatcaaagctttcttcattcccctttccgcccgacctccctaacgtcccccctccggggttcaagctcgttccttgtctgttggctggccggtctgccagtttctcctctctctcataagcgggccttctcttctcagacggacaccgcattgttcgtctgggtagcagatagtgcttccatagctgctcttgtctcggctcgagctcttcgcttttgatcactgaccactgccaagtttcaattgtgtcaaccagacttccctcgtcgatacacggatatggtctacattgggatccccaagaattatacgacttcgccgtcctcgtttgccgggacgccgtcgttgaccatcaatcatgaagcaactgtagacctcgactccaccaatgcatttgaaggtacgccttccctttatcagatatgttggatgagtcgtcgctaaccgatatttacaggaccagagaagttgctcgaggtctggtttggcccctctcctcaggatctactggggtccaccgagcctgctgggctcaaggccgttcccgtagaggtatggaaggacatgctggatcttgtcaattgcaaggtgctgtcgatcgtcgagtccgaggatgtcgacgcctatcttctgtctgaatccagcatgtttgtctggccccacaagttgatcctcaagacttgtggtaccacgactctgctctcgggactgccccggatcctggagattgccgctctgttcgccggctttcccaaatcgacggcgcccccgtcccgcggtatctccgttgcggctgctccgtaccgtgtcttctacagccggaagaacttcctgtttcccgaccgccagcgcggcccccaccgcagctggagggatgaggtcaaggctttggacaagctcttcgcgaacggcagcgcttacatgattggcaagatgaacggcgaacactggtatctctacctgacggagccgtacaccaccctgacgcctccgtcgagccccaagccggagactgagaccaaggttctgaatcttcctcaggagaagaggcgtggttctggacattgcgaagagaatgacgagacactcgagattctgatgacggacctggacgaggagaatgcgaagcagttctacctcgaccatgcgagtgcggtcgcagaaatccgtcgtcggaagctcgagcaggacaaggacgagccagttgacgtattcagcaacacgtcttcggacatgagtgaccctgactcggatggcgagcacactctgccgcccgagctcaccaccgaagggcacgcgttagggactgtcgtgacggagtcgtgcggtcttgcggatgtgtacccggtcagcaagtacccggactcgcgcattgacgcatatctcttcaccccctgcgggttctctgcgaacggcgtcatcccggcccccgacggtcaatctagcactcattacttcaccgtccatgtgacaccggagcctcattgttcgtatgcttcctttgagacgaatgtgccacaccagcaagacggacgggagacggcggacattgtcaagcatgttgtggacatcttcaagccgggccgtttcactgtgactctgttcgaggcgaagccagctgtggagcaggccgacgaaggtcagagctccaagctggtggaccgccaggctgcccttcgggctgccaagatggagcagattccggggtatcgtcgcgtggaccgcatcgtccatgacctggatgggtatgacctggtgttccgctactacgagcgcaacgactggaagggcggtgctccgcggattggagagcacggatgttgatgaatttttttttaattttcccctccctttcgtttgcttgactccccccactcctttagaagtctctcccactccttcagaagcgtgtggtgatgttgtgcttactcaatttgcaatttgttctggtcgattccctgaagtcgcaacaagtataatttgttgtgacgtttgttcttgatttactgcctgtccttaccgcgatagcttagttgataatttattgcgccttgctatataattactactatttggcatttttttaaccttttgaccagttgatcatctgtagaactatgtaaagaaccacaaatgagtaaaatatataacgatattctgtgagattctgctacaaataatttcaccgcgtagtctcagcagttgcgtcactcgacgtttggaatattcctattttggtgcaaggctcggcagacttaccggatgggtctgcgggagctccaagtcagtgactgcactgcggagaccgccttgcacaggacatcataccactttgacagtctcagtccctcctcttctctcagtgacaccgcgacatgagtcgctaaatactgctactaataagtctcagcacatttgctgagaactgcgcggatttgtttcccgcgtcaggtcacgtttatctcgcgtccacctcgccagcgggcgcgacatcgacagaaactgatactgtcacatctcattctgtcgatattaccatcctgcaaggatcttctgaaccatctcgatcaaaatgtcgtcgccacctcccagcacgcctaacgcgatcaacccccggaaacggccgtccatctcgtcgaccgcgtctcagcaaggcggcaacaacgccaagcggccgcgcatgcatcctctccgacagacgtccttcccctcgggtggcgatgctgacggtcgagcttacagtgccgccagcgatgcaggcagtgtgacaggtagttatacgggcagtctgggcggtgccagcgcggcgaccggtgagggcgtcttcacgaccggcaagaagagagggcgcaagaagaaggcggacaaggacagggaagacgcttccagtactcgagaggggctcgatacgcgagtgggccctgccgatattgatgggagttcagtgagaggaggggctggcggtgggggcgtagatgacgcggatgaggatgaggatctggaggatgagggcgacttgctgggtggggaggatgggcttacggatacggaggccgagaagaagaatcttgcgtatgtatttggttcgagatttgacgattacagatgcagactctgacttatgattttctttttctcagtatccttgtcgacgccttcaatcccatccagtccgcccgatacgatctgttcaaacgggccaagttgcggaaggagacgctgcgtcggatcgtcaaccatgcgctgtcgcagtcggtgcctgcgagcgtcgtgacgacgatcaacgggtttaccaaggtctttgcgggcgagatcatcgagaaggcgagaacggtacagcaggagtgggcggaggcgtttgaccaggccgctcgcgcggagtttgagagagaagaagctgaagctgaagctgctgcagcggcagcagcagccgcagctagcaggtcgtcctctgagaatcaagagggagcaaacggtgtcaaacacgagtcgcctgaaggaggtgccactcctgctggtggtggtacgcctgctactacagcaccaacgtcgataccagcgaacattcccgctgctctttcgcccgcccctgttcctcctgaccaccaatctccgtatgctcccagcacatccagcgatgcaccacccaccgtccggccgaaacgggagttcaaaccgcctccaaatccgcatcggggccaactgctgccgtcgcacctgcgggaagcgctgcgccggtataagcgggacggcgagggcggcggagtcggcatgtcggggctgagtctggcgaacctaggggtgcgaggcacatttacgtggaatgtcgggatggggggcaggcgattatttaggtgagcggcctcagcctgttgtcagggagagacctccctctttctctctttctctctttctctaactgtctatttctatttctatttctactacggaatgaggctggtgttctgttttcaaaaggtctggtgacaggagatacgatacatatcggtttatgtcaaagtaaagacaaagttttaatttaatatcttgcttgcccgttgtcagagataccatgtacatgtacatacatacattacaagaatggaaatgaaatggaaatgggaaattgaaaatacgttacgaggaggctattattatattattactaagatcacgactgacgagatgtgcgagacgatgaatgagactactactatgaccagtcgaagcagcaaatctgatcaattaattaaattaatcaattaattggtctattagtcagtcggaccgatcgagcgatcaatcgatctctcttttgagatgagatgagatgagatttctttccatgatttattttattttctatgagttccctatgataataataaacgaataattgttaggtaaatatataccacttacttgctgatctacgtaattaactccaagtcctatctgtaagtgttacctatactgcagcttctgcagtacttaagcagctgtaaggtctatatgtaatattagctaatagctctaaatatagcagaggatagaaggggatcgactgagtgtttctaaggagcattcgcttggtgggcagtagtagttatatatagtatagagagaacacccttatctatccacccatctatctatctatctatatgtacatacgctagtgccagtctgctagctgtctcgtctgatggtactattttagaacctaccttacattggaagctctatttgtaaggaaggctcaagactcagtatcttctttgcatgtttgcttccttccttgtttcttactacgatccgttcaatggcctgcaatttgggatgtctttcttttggtgattgcgcgtttcaatgctaagtgttcattattttttttcttttttcttatcatcgacaacaataatatccactaatccgatgagatcaatactaataactagcctatacccagtaccgggaacatgtgccgaccgagtcgttccactttgcgtcagaagaggccgcgaaggtatcatctgtcttaaccctaatctgaattagaatcgcatgcttatcgtttctcaacggccagaattgtaattggtccgtaattaggtccgtgcatgatgcgctgcatgccggtagttttcttttaccggctgcaaacggtgcaattccgccggtacagaaatactccgtatggaagagtgacggccagaacgattgattgcatgttgctgcaactcgctaggaagtacagcataattttgtcctgatcacgcaagaggtgagccaatgggcgtttaacatatgtatgtactgtacagtacatatataaggtatatatatcttcagataaggtggatgtggtcgtagtgattgctcatccattatatacatacgaagacaatagacaaccactgctgcagctacgaaacaaacatgtctcaacaaaaagacaacaacaacagcactatcaacgtcgccatatcggcgccggaccagccggcttaggcgccgcaatcgagctcaactagctaccgttcgtcgactggaaggtctacgaacaggccactgccatccgcgagatcggggccggcatcagcatccagcccagcacatggcggctgctcgaggtgatgggcgcggccaagaatttcccctcgagggatatctaccgtccacgggataattatgcggtgcagcatcggtaggtttgctggctgggcacatgccatctgatatgctgatgatttcaggaatgggagaacaggagagctgctgtattcacatggtcaagaaggtgcgcatcgactaagaaaagaaaatgaacggcataacttactgttgatttcgttcaggcacacccctagatcaactccacgcccgcacccagcggtccaaactgcagcaggtgcttctcaaggaagtcgaccagtccaatgtgtttgtcgcccatcgactggtgcgcgtcagccggacggcatcgaagcgattaaccgttcacttccaaaacgggtactcggatgaagttgacctggtcgttggcgctgatggagttcgatcggtggcatcatactctcaaacttagcaaagattataacattataacagaccgctaactgtacatcaggtcgtccgcaatttcgccttcccagaccaccgcatcagctacacaggcaagaccgcctaccgggtcgtcgtccgcgaggaggatatcgcacctctgaacatccccgacgcagtcaccttctgacatggcccatcctcgtggctctatacgtgtgcccttggggacggcaaatacgagatcaccagcatggcgcgcgagtctgatcgcgaagacgcggaaaaagtgagctgggggcaggatgcgacggtggagcagcacgcgaggcactttacggtagacacgctgaccctttggctggcttttttcctaataattttttcttttaggaatttgcccccctcgtcaaagaaatagtcaccttctccaaagacatcaagcaatacgctctctttgccggtccgagactgcaccagatcacagcatttggatcggtggcgcttgtcggggatgcttcgcatcgtgagtattaaattcaagcacgataactacttactgatgctggttacatattcagccctctctggagcgtttggtaaggatagttattattcacgtggaaaaacacagactgaaggtggttattgcaggcgccggtgccggcttcgccctcgaagacgtctacgtcctaggacaggcattgaaatgggcccatgaaaatggattagatatcgccgctgcgctggatctggttgatcgagtccggtcgccgcattacaagaagttggtgagtttgcctccatttcaatcacaatattattcatttatgtataaagttctggtgaaagacagtacgacatcctcgacgaattcgccgccacagacgcctatatcagatcgcacagccctccgctttcgttcgatgaggcagtggccatccttgcgagggagacgtggagtaaacgacatcattggatttataattatgatgtaagacagcaccatagctcattcttgatataaactagactaactatcttgagttatagatccagcaagtctgggaggatgctgtcgcggcggagaagcgtctgcgttcgccagctgggtctgaaaaaagatcgaagctgtagaccacgccagaccatacctctatatacgtgggtactaggtaacaagagtttcttagagttcatttaaggtagactgtcgtatgaaaaggtgaaacagatctatactacagcatgtatctgttagtacaatgtacatacctaccatgtgtaggtagagcaacatccttttatcacaatcgatgcatgtgatacagaagcgacagctgacaccctcacgcattcgatacgcaaggactggttcatcacttgggggatcactgcattcgcagatgaacttttcagttgccattctggactgacgataatctggagagatgatggatttctgaggacctcgatgtgagaaatatcgagaaatatcgtggatgcgggatggagtttggatggttggatacgcgaagttgcttgacttgcttcgacgatgtcaggctgtgatcgatggcaggagaatcagatcagatcatgaacggaatcaatggtatatgtaatgtactttgacaaagaggaagaatagaaaggagaaggaaattacctaggaatggatttatatggcgtgtccagtgatgtatgactcttccatcgactcattcttatgacagcaaattccgcgcatttggtgaattttgagtccattgctcagagaagaaaggggatctcaaactgaatgggaataaaagagcaagtcaaaaaaggcccattttctctaaagaaaagagaggcagaggacggaatagcatctatatgcacctgtactgcgctggttggatatggacgccttatcacgtcagagaagatagttagaaatcaaagaagtctattatccaagcatgtatatatgtactgaataaatacgggtaaatatattactcacacatgatgatcagaagaatcaagagaccaagactcttataccacaaatagatatatatgtacccttcaatttactgagcagactcaacgattctcggcgagtaacgagtccatataggccataagctcctcgagggtcgtcgcattgtcagggtctagatatttgttgtcgacactcagtcgaaaaccttccggggtcgtctgcgacgcccgtgccggtcctggatctggagaatcgggctgcggcacctcgttccaacgggcttcgaacccgaatagaagtctccgcagcaccagctgagtattcaggatagccttcttttccatctcctcccgcaactgttcatcgctctcactctccaagcgctcaaactcggcatctgtctcatttttgatgattttcaaatctttccatatttcccggttgtcacattgcatgcatggaaagtggaatttgatctcgtttcccctttgtgtatggtcatggtaccgatgcgatggtggaaatggacaatcgggacctaggtcgtgtccgcaggagaatttgcgcgaggttttcccgtagttgtctctgtttgtaatattcacaggcatgtctgtggcaggacttgataaatatatcgttccttgctaggtatatattcaggtgaaggttagaatacaagatgatatctgtagttagctgtgtatgaaaagagaaggcagtcagaagcagggagattttataccatggggttgacatgtcatagcccagtcataatgctgttgaacgcataataccgctgggtttgactccagtgtcggagaaatgaagatgactctttctgaatgactccgttggagggtgatacccgactaacaactaatgagtgaagatggcggtgggtgttgatgaataaagcacccagagatatcgcctgttaaagagtcacgaactagtcgactatcaccctccaacaaaggcactcagagggaggaatccgtcgatcttatctcttgtcattgttcgccgacttctcatcccgtcacgtagtcggatgtattcatcatttgcaaggagatagtcggtcgtcatgttgcaaccaacagcacaaaggtgtaacactcctcgtatgcaggatcatcagtctagcactgacgaacttcgtcacatgctcctgcaaggtcgtgacacggaggcttgccattataaagtccatcttgaaaagaactggaaactggcgtcagtcctgtccattgtgtaattataccattcgagtactcagccagtctctctttcaccagatgcacaatcgttgcgacagagaggtatgtagagcagattcgcaatcagctcaagtctgaaagtggcttttacggcgggaaacataggtgtgtttcgttgagacaaaagaagtattcagattgtcagatacgaagatcattgttgcagaagttgtttgaggtctggcaaagaacaaggttgcacaaggttatcgtcgtgcaacgtggactgccatcgtcacatgattacgtgcgattctcctacctacacaggtaagaaggctcatatcaacttcaaaatctccttatataggcttgtcaatcaataatggaaacttctcccggttccagtgcaggatctcactcgattcaagcacatccttttcttctatttcgaagacttttctttcaagatatgtctcataaagagcagcggtttccttgcatgaatcagaacaaatctgcagaatattgcacctgcattgcaaataatagccggttatattaggcagctcaaaaagaaaagataaaagaaaaagcaaataaagaaatcgtcttattcgtcatcggcgacaatattaggcatctaagcattttgaaggcaaccggcatatctgcatgctcccgtcaggcaactccagccatgttgtgattaacaggggaaagtaccaatcggactatgaactggatatccaaactaatggattcggcactccgaataaagggaacaagtgacgatgacgaaaaaagaaaaaaaaagaaatcggatcaggctgtaaggactcctccataccgtattcgctgaaaccgtatctatccatgtccctgtttgaatgacatgtcttttgttttctgcagacaagttacgcagttctctttggccagtctgcttttactgggatatgccttcttcagtctcccatataattaagtagagtgccaactaagcactaagagaaaagggagacagcaccttttcagcagatcaacacttatacaggcaccaaggcatgaggtattgagaactgaaaatgtcaaactatagatcatacttctcctttctctgtgctgtgcgaatcccaaagaaagagtcaacctgattaacgacaaacatcaccaccgcaaggtaccaggtagacataccccgtactccgtacttagtgctgatattatttttatttccagatagagaaaggagagagaccttctccgatccggcatttaatactcctgtagaattaacttgcggggggtataatactggttcaatcgaatggctctatggatctcccctatttattatcatacccctatgcatgtaatattaatccgtatgatctgatctgatctggtatgatatggcttgagttgagatgcacgaaatagaactaataatataataactatatgatataaatagagctgcttttcgcagaggagaagaaaagggtgttaaaaaacgagcatggagcactccctactaaaaataaagacagatagacagacatctgaaatatttccgttccgaatactcaatattattgcacttcgcatactccgtacggagtactcctttccaaggcgcactatttacaacccaaagagaagtacggagtagtaacttccatagtcccattattattgacagttagatatacaattaaaatttagaattccccaattcttggaaaaagccaagactactaacgtacagaggaaatacggagtagacaaatgggaaaagggcacgtgacaaatgccaaggcgtcggaccgaatctaatcatttactaggaaaaatctaaacatttggtaggcaagttaaggggttacaatttacggagtagagtaagtagaaactgcggtacaggctgcccagacaatagttatgtttcgactttaaaggggtgattgttgcatcgcatatgagtaccccgtacggagtgtacagtactctctctgctgaaatctcaatactgaaatgttgatgttggccttctcagctatgcctgggctgagtttacgcctagttatcttaacgaagtgcatgcaatatgtgaatgattaccatatagataatcttactcgctaagataaatgcgccgcccaagtccaaaatctgcctggactggcatctggactcctgaacctggggcatctcattactcccgtattgtagcagggtgagacttgtggggatggtgtcccttttatcttggcagcacggggtgaagccgacaaggccatcattgccgccaccttcgctcgcttgcacattctgcccagcaggacggtgtacagagtatcatcacgcgaaggcagcaaggcttcagcaaccttcccagccttattgggctggcaagactcaacaggctgttgggaccgtaacattggacgcatgtatggtctgtggatccggaccgtgtgctggagagattccaagcatctggacaactgccgcagccgtcatgaccaatgataatcgcattgtcagcatccaaaagcacccgactctccgtggtttccggacggccagggccaagcagtgcgattgggcggaatggccgtctgccaatgtcacgaggttggccgtggacatgcatcgtcttggcggagcgggatggtctgaaaccagcggcagagactccgtaactctgggcacttccacgctggcggagacgtgccgggtttccgtatttcttggctcctcccagacggccacgggcaggtgacggttggagcactattgcaatccgtcttcatggggtgaccgtgtctgtttgttggaacgaaagcagagaaagattggcagactcgcccggatgcgggcgtccgcaccagctgcaatgtgcgtcccggatgcgtgagacacctccaacgttgcaatttatcaacgcatccttgtttgtatgctggaccatacggtgtacagcgaggactcgggattgggcagatctgattcgagtcgcgggaagataatcgagatcacggtgtctgcagtgcagatgccaaggcccgctggtggaggcagtggagcggagcacgcgacgctttcagggtcctgcgatggcggaagacagttgctgggagctgagacgcggttcgtgagagttgtgcagaaatcatctatcttccccttgaacggacagcaggcactgtcaaggcaggctggtacggagtagtggtggaagaggagagagacagccgacgtctcaggcgctaggcgagacagccggactagaccgagccggggagaggggcgtttgtgcagcgttatgcggtcatggatcatgatggatcaggaatggcgatcgctggctcgcgggccgtgactggcgcagcgcccagtaggggatggcgcaatcggctgctaagcagttcctggcggcttggctgccgctgtccacgcaagcgctccctagttcctggccaccggcagcgcgcctccatgcctgctttaacccgccgcctgtccttgccgggggcgtttttgtgccagtcccagcgctgcagcctccacggcctctcccaccaccacgcataccattcctctcgacgctttctgcttccccgtcttcacttctagtcgttctttacccccagccgtctgtcttttctgtgctgtccgatccaactatctgattatctgagccatctgatatgattctgttgaccagaccgtccctccttttggtgctcgtcccataattatgtcctacaatccttcctacctctactcccgcttgcgggacaccatcccagctgctctgccgtggagtggcggggacccctccgtcaaaggcgatcccaaaaagacggtcaaatggatcgatgtatgcctgcgtcgcgtgctttctgcccgtttcctcatgcaagagctgatcttcttatcgcatctgatagggtctccgtgggatcgcgtcgttcttggtcgtcctcacccatctggcacgagcctgggactatgatctcttttcgccgcgagacggccccgatattcctccccgactcctccagtaccccgtcttgcgcattccatggcagggtcgtattggagtcaccatcttcgccttcctcaccggttatgtctgcgctctcaaacccttgaagctgtcgagagccggcaacaccagttccgccttcaccaccatcgccaagagtgcctttcgccgtccgccgcgtctgatcttccccgcgaccattgcgttgctcatctcctggaccatcgcccagtttggaggcttcacggtcgctaaccgctccgactgctggtggtgccgttatgccgcccccgatctggaggactcgctgtacaaggaagtcatccggctattccagaacttcctgagcacgtggaccaccggctacatggcgtacgatgatcaccagtgggccttgctgccgttgctgcaaggatcgatgttgatctatatcctgctctttgccaccatgttttgccgataccgatggcgtctcctgatctgcattggcatgatcctgtattatcatcaagacgccgctaaggacaccggtaggactttttttttctctattgctcacgtgcctggctctgacaaggaacgcttttcctagaaaccttccagatgcagtgcgtttatggaatgcttctcagcgacctgtcctatgagatctccttcaaggaattcctcgagaagtatcgctggcctcgacggttcgtcgctctgtgtctggtcacggctggtctcttcatcgcatcctatcccggcgagcacccggaatggtcctcgtggtcgaactacatgtatgagatgtctcagtatcttttccctccggaggtcaacattgggaaacgctatacagctcttggcgtggatatgatcatctttgccatctacatctcgcccacgacgaaggagttcctctcgaatcggttactgctctggctcgggaagcagagctttgcggtctacctggtccacgggaccttgttgcgcgtgcctctcgtgtggatgctctacgggatttccggggagccgtgggaggagacggtggacgagaacggcaacgtgatcccgccggcctggctcccgctgcgtcccccgtgggtggtcgccatcagtatcccttgctggctcattctcgtgtacatctgcgcgtcgctgtggaccaactacgtcgatccgttctgcgcccggatgacgcagaagctggagaacctcatgtttgaggaggacgagaagagtcccgaatcgattccgatgaccacacggccgatgccaatgacgtgaacactttgcctgttgctgctccttttttccattcttcttttttatctcgctagacatatatacttgctttaatccgggataccttttctagatatattgcatctgtcgcgggcggatcttgctatatacaactatcatgacgctgatttttttgtcactgttacgggggtgcactttggaagtgatcttcaattactggagttggttctacggattcgggtctccagcatctcgttcatcgcactcgtttgtttctttttgccatctattgtgccatcatgctcgacatatcgttgttggatctgatttgatcttgctgaaaaagaattcttgttttgggtgctgggactatactgtactgtacatattgccgcagtcaaccaatggacatacgatttgcttacttgaacgttgcatctgcgacctaggtgctgtcatagtagtatctctggaagcgtctagcccactggcggtgtctggggttgcagggtctggcctggtctgcgtggcagcgtggttggccctgcatgtgcctggcacgtgcgtgggggattggtcttagcttcagcctcccgcacaactcgacaagcaacatgccatgcagagagatgcaaaagcgatcaaaaaatcgaaaagatgggggccaacgacttttccttgacagggactgtggcgcatggagatgacgacgacaggccacgcgtcctggtcaagctttttttgtctttcttgtcttttttcttggatgatgatcgggggcgatgggctccattgagtgatatattgcctgtttgggaaggaaactgccctttctacggtgtagtctgcatgatggatggaagaggaatgaattaggcaattcattgattctatggcgaaatcgacgatcattgctattagtaccgtactctgtacagtccgctgtttcagtccgtcctagactcgtcattattcttattgttattattacgattgttatcagggattgattattgctccgtacggagtaattctgtcggcgattcattcggtgtgtgtctgtgtgtcgggtgtgtcgcatgacggctgtttctgccgaatcttcttccaccaatcatatttaatcagacagagttcagcagcgaggggcgaataatgattttcttactgacgggcttactgacggggagataagacggcgcggcggtgctacagcctactggaaaccttagaattagattaccgcggctctcgacggaatgctacggctacagatatcttccaaggttgttactaaacggtttgggcaactcagtcaatctcgactaaacctactccgcacggtacgtagtggacgggcaaatttgctcggagtcgttgggcaatttctttaggtaatgtttgttgcagagacggagtattattattatctaccaaggtacctacaactgcggctgagctgcctgcctggcttatacggttttttgacctcaggccgtgtgaggtggagtctggatttctgacccacctgtctggctggctgtgtgataacaatactctgtacggagtacggagttctccgtataataatactacgtaccgaataacaggcacggaggacggagtttactacggagtacggatccggggaattggcggggaagataagatcaggacctgatctttgggttactgggtacgtagcttaatgtcagctcaagttacgaacagttaaggtgtcagctgggcgagacagaaacaggtatctgcgcacgaggtgacacgggacttgagggttggctgggcgcggctggtgcatctactgatgatgcccgcccgtctggatgccaaggacagggtggagtaagaataatattccgtacagagtagttacagattgagattgattgacttgagagagaaaaaaaaattttttttctttgccttctaccgctctctatctacggaggagagatcttttctgcagtgtattccgttgttacactgtgatcaatcaccttagcaagttggactaattagaattcaaactggaattaccgaggagcattgacacagtacggaatacctaggtaatggacaactaaatccgtaatgcaacgaactgtgcagttacctacggagtacagtacatgcgaagttgcaatgaattaattgcgactgttaatcatctgttcctcgttactccgtattctctccaagatttgagaacaatactattgtgatttacctacctacctgaagagggcctcggaaattgcatcatgattggcccggatggagattgatagccagtccattatgacattctattggatttccatatctgcagactgattggtccatcgggctccatcgatagatcagcgggtccttcatcccgtccgaggtacggagtacctggtacttacaagcaagttcctcgagaatatgaatggcctgattatctgataaggctctttatcgccctactatgttgtactatatctcattccctgattacctttctctatttgttcagtcaagtacggaaagaacagtgtatgccgtacaccatcagatcgaaaattcggtactccgtacggagtatacgggtccagcggtcatcgacgatcggacgatcatgacttcatagcgcaccggccaggatcttggctgacccctgaccatggactatgaactcctccagccttgcatcagaagccagacgggatactgaaatccgctctttgattgatcgatcgatcgattcattcttgtctgccaattctgttcgatggatttgaaaatgtgaaataaatattccatggagtactttgtacttcgtgttgggctgggtgcttatttcgttctcggcacctgcttgaattattaccatcattgattgccatcatcatcgctgatcatcattcagggaactcttcatttttttttcggtgccaagattcctttccttgggaatacaccatacggagttgctccattctttgcatcaaagatgacctcacaatattgcgactgttcgtcgcatgcatgccctcttcaaacttccagttcagccggtgggggcacgacctgctaatcttaaaacacatctcgagttgacgtactgaacaaggacgggataataatgcagcacagcagttactccgtacagatcgtcggtagttatggagaattgacacgtctactcattatgtcggcctgaagacgcatagaacttgcctgtctgtcaaaacaaaggacaaggctgaatggctgttatatgtcatttcttccaccgactggagggtgggaatttttgtcttgtcgatatgaaacgcaaattgtgctcggtatgtgacgcacaccgtccaccgagcaaatcttcatcactcgacagatcttctggtggattttaattctctgaattccacagagatgtgatggatgacaaaggtcagatgtgccgtctgcccagacgtatcagaaatggtaccgcttgtgaatttctcccatcctcgacactgagcatcatcaattgcatctccaagtctgtcgcatgccacttttgagaagcgtcctgaaaggaaagaacgtgagtcagatgccagaatatcgtaccttcaggatcactgtcgactgccaagtctgttacatgtacctatttggtgagaacagcagcactcttggagcctgcatttgactcagatatattttagagaattcgacccccaattcagaactgcgtgatagataaactgcatctcagccattgtcgaattagtcagaatgcttgcactcagtcgcaaggcaaagtccacagagatggcgaactcgaaattctgggagatcgatacaatatttgctcctgtgatctattattggatgctctctgatctgagtagaataattatcagctacatgcacaaatgactttccggcacaattgtgattatactttgaaataaagttaactcgcatgcagccacccggagtttaggagttaaggcccgaatcgtgatcttggtgcgtaagcgccttctttggggaacactagatccacttcgctgtgattctcgtggtttcctctgttatactgtttggattgcagacgggacataatggcttcggtgggacgattatctgtggtgtcattttgtccttcggagataggagtttagttgttcttcatattaaaccctaacgccgtgagtgtacaatccagattgtgctagatcggagaccattccggcttcttgaatgtcatctctcatagaatcttcttaaagagagtgaattctcgctgtgcatgttgagattcttacgactgtgctgagcatcaaaccaacataccttctctcgaagaattcctcgtcagcttcattacggcggatcaagatggttgaatacggcttcgctacgcaaggccaggagattgtctctgcatttgcggatcaagtcaagggcaaaacttttgccatcaccggccccagcgaagggggcattggcgcggagatcgccatcactcttgccaaagcgtccccagcccgtctgatcctgtttggtcgctcgcgagaaaagactcagagtgtcatcgactccattgcagctgccagcgagcaatcctcccccgtcgagacggacttcattcaggtggaattggcttcccttgcgagcgtgcgaaaggccgcacaggaagtgctctcaaacactgccatcacgcagatagatggcatcgtcaacaatgccggtgtcatggctttacccacatacgagaccacgccggaaggctacgagaagcatctggtcaccaactacttgagccacttcctgctgaccaacctgctgatgcccaagctcctggcctctccctctccccgtgtcgtcaacctcagcagctacggccaccgcatgtcccctttccggttcgatgatccccaatggtccaacggcgcgacgtaccatccgacttatgcatatgcacagagcaagacagccaacatcctgttctcggttgctctgaatgagagattgggcacgacacaccatctgcggtcctacgccgtggatccaggcagcgtagccacatcgctcactcgacacatcaccccggaccaattcaaagagggactggagctctttgccaaacatgggattgtgcgtccggaacgaaagaccccagcccagggatgtgctgggccgttgagagccctgctgcagccggatatttcgaacgaggacggtgtctacatcacggacacgaagctcacgacggatccggcggtcgtcaagacctacgccacggaccgtgaggaggcacgacgactatgggagttgagtgaggagtgggttggacagaaatttacgtattaattgcaacttgagggctgctttggcaatatagcgtagtagttttaccgttatgtgccgtccgtctgcgtcttacagtgtaagcatagaaattatgtcttcccatcaagaggatttaatttcgatatttactcctcgacgttgttatttttgagcctggactatgcttagctggcctgcataactcaacaggaatattgtactgtggagtacataacatgatttccaagtttgctacttctcattggtttaccccacaacggccagatccatgcattgttaacctgcttcagctctatctatccatgcaagatcagaaatgcctagcaccctggtcattgactgtgcttacgtgcagagtaaactgcctcaagttcggtagaaaatggatttccctgccccgggaaatggcgatcgcgcattgaatctccccacgcgcgggaggcctcagctgtcgtgcacgccatgcaatagacgaaagtcaagctccctgcatcgcacacacccttattctgtctcgcttcaatccacgtcaagcttactaaatggcgatgctgcaggctcaagtgtgacagggcacggccctgcgacaactgcgtcaagagaagggagtcggacaaatgcgtctacccggccgtgcgcgaccatgcccgcgcgtcgaagcggacgaaaaagcgtctcgaccggctggagtcgctggtgatgggtttaatcgacaggagtgttttgcaaagccgcccctcgctggatggagagcagcagtctctcggaggaagtcgactgcatgacagcgacaggcacaggaaccttggcagcactaatgaatccctactcgacaagccatcgataccatcctccagctcgtcatctgcgctgtgggagagtgtcctgctggatgtaagtctccagtccggttcacaagtcaatcgctgatgatacacgcatatcgtacgtgtatacatcctgctagatactgacgagcagtatgggctcctagatagcagaaattcggtcctatttcgaggagcatgagctggactttcgcgagcaggaaataaaagtggaatcctccaggaatccgctcgcaggtatcaatatcttacacaccagccccggtgaatgcgacatggacacgctcctttcgtctcttctctccaggtcggccgttgatctgctgattgaaaattactttggcatgacgaaccacagtagacgtaattctcttctggctatgaagatcccatcgcgaaagattgactaacttgcgtttagcgataatacatccgaaaaattttttgcgagaagtatagactatccagatgaaactgcagactaggccactaaccgctacatagtatgagagattctggaagaatccctacgacgtgtcgaagatgtgggttgttcgcgattatgcggcaaggcgtacgaacctgtatagcgaatggcatcgacctgagaccatttctcggggacccagacgaagcgatggccctgtttcggacccggacgacacaatgcctggtatcggcggactattccaagcctttgatggagcagcttgagactctcgtcgtccacctcgaggccgagttcacaagcagtccggactctcaaatccatgtctgggtcttgatggggagcgtcgtccgcctggacatgcgaaacggcctccatcgcgaaccgagtttatttccggagtttacgcccttccagtgcgagatgcgccgtcggatgtggctcgcgatcgtccagactgacatcctcatgtcattccaggtgggcttgcccgcaatgattcccaaggggcagcacgacacgatgcttccacaaaacctgcgagaagacgatttcgacgaagatttcaccgcgcttcctctgtcacgacctatgaacgaagtgaccaacatatcgttctttatcgccaaaaatcccctgctcgaagtcttcgccaagatagcgtctcacatcctggacatccatcccaacgaatcggacgtggagacgctggagagcgaattgtacgccgcccgggatgcgttgcctccgtactacaagatgcgtccgctggaagaatccacactcgatccaccagacgttatcctggcgaggatgggcatggaccagtcagtccacagcggactgtgtattctgcaccgacgacggttgcctctggcgcgatcgaagccgcagttcagctattctcgcaaggtgtgcgtggatgcggcgctgacgctgctcagttaccaagccatccttcaccgcgagagcggcccaacggggcgatttggagcgcacagggtgatggccacgtccgtcacgacgaatgactatctccttgctgcgatgctcctttgcttggacttgcgagtgggcatgtccgggccgacacatcctgcgtcgagtgatttgagtcctgtggggcagggatcgacaggatgaaatgatgcaagcattagagacgtcgtaccatgtatggcgggattcaaaggacagatcgatcgaggcgtttcgagcgagtgaggcgctggccgtgatactcaggaaggtccgaagtgaggatcagggggagccaggagacgccagccatgaagcagtcgatccattgcgtggtggtgaagacggtaacaatgtgcccccagcggaattcgctttttttttaataaaaaaaagctgactctgcaagttgccctccctactggtaacaatgccgacttaccaggcgcgtttccgccagaggaatccgacccgtataacctcagccttcctttttcagaaatggtttcatctccgaatgacatcaactgggtgggcatatgtatcaacagcagtgttcggactaacaggctaatgttacgatctattcgcaggtggagtttgattgtttcgtgcgtgggagcattaattctcctgatgcctgacgttggactttgaggaagctggaagagtgctgatcgatagagaagatagaaagatggaaatcgatcaattcaattcaattcaggtaattaattaatccccttttaataatcaaccaataaccccagaatggggaaaaaaaaaaggaaaccaattcccaattcgaaaccccaaatcctcctttactacctctagcagaaatcactgcatttcaatactttcagcattgccatttccaccagtagcagtagcaccagcagtagcagtagcagtagtagcagtaccagaagcaggacgagtctgaccagaccttccgcgaacattgcgcccacgcacgttcgcattcacgttattgttctggttcgcctgctggtttgccgtccgaagcaaacggcggtggcaccaaaacgcgttgatcgcgaaaataagcagcaccaccaggccgatcgccgcgatgacgatggagagggcggtccagagacggttatcccagacgatagataaacgcttatccatgatgataggatggatgagatgggatgggatgggatctgcatttgcggcgggcgctattagtcgatttttttatttcatttttttttatcaaatatgcatattatagacttgtcttatcggtcgatagactgactcaagatgggatggaggcagactaacaggattgctttctgaacttctccttctccttctttgcttctttgaggcagtagcagatgtttctgtctgacatatactgttagaggatcccgttcacacggtagtatactggacactgtacagtacaatgtatagggtacatacctttgagattcaacttctttctctctcacagtatgtatctctgtgtgagatgaggatgtgaaaaagagataaaaaataaaaatacatctacgtgcgtgcgtgggtgtttacgtgcctgtttacatttacctactccttagttagggctattgccctcttctgctctcggcggacactttatcatcgtatctgtctccctgcaagattgagtgacgatatagctcacagataaacaatgtgcatctctagaacatatgcgtatgtaggtaggtaggtaggtacgtatgtgcatgaaacatcacagcacatcgaccacgggcggccgccccagaaccatatcttcagttacatctctaaaagggtccagggaaatctacaacaggaggccccctgaatatcatatcctgagttcgtcccaaatcagtcagtagctcagcgaaagtacttaggtatttgtgggaaagaaatcaacagcgggagcactcttcagaatcacattaattgttattactattactattatcctttgtttggagactgtaagacagaaacttgcatagctagctgatcgattgcctacatacactcgagtattcaattcatgcttgtagcggctttggtggcaagaatcctcccgttgaatcaatcgtatgtacgatccgagagttatgatatgatatgataggatcatcctgtattagagacaaatccttactgtatttctatagagtaatttgtctttttatttaaataaatcaaagcttcttcaaatacattcctgaatggtacaagttagttattttacatgcagtaaacaaatgccgtatgacaggagaaagcccttgatagctgccaaacgccgtccccaaaatcttatttaatttatccttcgactgataatacttcactgctgcgccttcatctcgtctccttggaccggtacatccgggccgtcttctctcgctccgcctcgagagcacgcatatatgcctcccgtcgcgcatggttccgttcctgccgcttgtactcctcttcctcttgccgcctccgttcatactcctctgccttctggagatctgccttgctgagtcgcggcggcggtgctcctggcgagccggccgcattcgagcccccgccagtgagcccctgcgctttctccagaacttcccgccgaatgtccttcacaccctctgtgaacctgttcaccgtcctgtcgatgaagctgattgagctcttgtttgtgtccgctttgaattgatccttgaaagccttatccgcttcggcccggatgctatcctctatcaggcggatgcgacggcgctcctgagattcgctctctgccttgcgatgcttgggcaagggagcaattcccaaccactttcggaaaccggcattgttcagcaggtagctctgaccgatggcgaacagaccagtgctggcaaagtagagctgtagagcacccgggaaaaacgccgtgaagagaaatgaaagcacaggaaacccatagataaaggccctgccaatggccgactcttggaattggtttaatcccgcgtctccacctttctatccagcgattagcctccatatatcatcttcggcagcgatggacatacccttatgctgagatagaagaccgcggcggtggcagttggaatcacgaagtagggatcactgaccgtgagatcggtgatccaacccaccgactccgccgccagacccggcaccggaagcgcagccatgccattcaccactcggaagcaaccgtaactcaagggaatattgaggaataaaggcacaagggctttccaggttttgataccatgtttcatattcaagtcttgcaattctgctcgggctttgatcaactctacctggttgccatcgcgcgcggcgcgcaccatgcgctctcgaaccgggttcacgacatctcgaacagcatgcaatttggccgccaaatccgaagaatcgatcgcaggcttcaacatggctatacggactagaataccagcagcgacaatactggcccaccagggcagacctgtccagatgtgaatgtgttcgatgacccattgcatgagagaggatgggccccagccataatccagtcccagctccttcagatatccgattttctctgggatttgttcaatctccagcgccgagagatctgcgatatttgtcgacccggtctgagcggcatctgcagtggtagtagtagtagcggctgcggcggtcgatgtcgagttgaaacgagcaaaggacagccgggacgcggacgacacgggcttccaagaagcattccctggaatcgtcttaccaagggagactggattccggaaagaccgcgaggcaatggaagacaactatagtccagtcaacttctgtctcttgcatgctaggaaaatcggatcaggaaccaaccgatcgagtagagcggagagcggtcaatcgcgtgctcgccatcctggcagctgtggccgacctggtcaggcctgtgccgcccagcattgtgactgcccgatggcgaagcaattgtgtcgagaggtgcaggcgaccgaacagtcgactccgtgagaatcgggattgactgctcgatctttttgtcggagcatttttggcgccaagccagttctgccgggcggagagcggcacccccaatcaggagcgccgctcgtccgcctcatgactctggctattcttactgtccagggaactcttggagaggaggattaagacagtctcgctgatgagccagcatttcaacactgtagattcgtttacaccaaatgagacattcccagacgccgcccaatagatgtacctcactctatgtacagtaaatatcaagacagatcgtgggttgcaagcaaaaacaaacaggcatcatgacaccagaatgcatattttccagatacgatagtggttcgcatccaacagatctaaggcaggtaataccgtgttgtcggcgagggtcaccacttattccagagacgtcgtgtcgttcaggttggcccgcggagccctcctctgggtcgggatgtttctcatctcaatgcccggtccaacaggtgttgagcgtcggtacgtagggaagatctgacagggttgttagcatcaattgcagaccaggaatggattgctagtccagcagggctaaagacaggcctaccttggtattagaccagcccagacggaaagctgcttcatgtgccagcagctcgcccaatcccagcatgagcccgttgacaaagggcaggatgaggttgatggccgcgccgcgcaggatgctccacagcgagggcggtttgtagaggatcagcggagaactggacgtcgaaggaggcgaggatgagagctcgtggttggccgaatagttctcagagtcggagggcaccgtcagagccgagtcgtagagctcgatccgcgagcccgaggtgttttccgatgtcatgttgacagggctagtgagccaggcggctgaagatgagggcaacagaggcagagcagccggctgtctctggagtagcaatgcatgcaatagctggtgcgaaagagcccgagactctggtggcagaactgctccagtcgtgacgatgcgcaactcctctcctccgccgcggcggttggcatgaacatcacgcttatgtaagccacattgtacgcaggaaagcagtctcttcgccaggcggttgatgaggaatcaatcctatgatcctcgtagctgagggcatctagtcgccttgaagccctagtctactgtctctagagtccagaataccaggacactgtctggtctggtgtcatcacactggttctctacagttccccactcaagactgttatgcaggtagaagcttctctgtattgcattcaaaggcctattcgttcttcgagacaattggaacaaatcgtctcttaatatcagaatgggtgatatcaataataatagcagtcatcatgccaaaacactagtgtagaacgatctgatgcagttactgcgcgccttttcgtgttgaggctcggcggaaggtcctcggtgggatgaccaatcaggcaaccgtgacgtacgtgaccttctctgttgttccttcgactcttcactgaataatcactcggcgagcctacatcttgcaggcagggcgctctcttccatcttccttcctgttctttattttctccttcatttcccccgctgctgtctctgtcttctccactatcagcagcaaccccgccatcgcgactgctgtcgtctggccaactccaacatggcgtccaacgcgacagaccaggatgagatcgtctcccagttttgcgccatgacggggacccgtccgtctgaggtaagcatcggcaaagtagtctatttgggcatcgcattgctaaaagaaaatcatgacgacaggctcgccagttcttggacgcgaacgagtgggacatcgaggccgcagtcacggaattcttcgcagagcaggatgaggcactacaagatgcgaatgctggaggtggacgacgactgggatcggatgaacctgcaccccagccgtctggcggtcggacactgggaggggctcctgctcccgcctctgcttctgcccctcgccaatctacccaagcgcgacgacctcaacagaagaagtttgcgacattgggagacttgcaagccagcagtggcgctggagagtccaccgacgatgaggacgaaaaccaggacttcttcgctggcggtgaaaagtcgggcctcgccgtgcagaaccctgatgacatcaagcagaagatcttggaaaaggcgatgaggtgagattgtgggctcctgggttatcctcgatgtagccgctgacaatattgaacagggcacaacctccgccagcagatgataccaaaaccaagaaaacgtacttcaccggcactgcgcgcaccttgggaggagacgacacccctagccagatcattccagacccgaacgagggccgaccgcaacggccgccccgagtccgtcggacgctacacttctgggcggatggcttttcggtggatgacggcgagctgttccggtcggatgaccctcgcaacgcagagatcctagatggcattcgtcgtggacgcgctccgctgtcaatcatgaatgtccagccgggccaggaggtcgatgtcgagatcaaacaacacgacgaaaaatacgtcaagcccaaaccgaagtacaagccattctccgggccggggcagcgactgggcagtcctacaccggctatccgaacctctcaagcagagactacccctgcacctgctgctgcagagccgccaaagcctgagatcgatgagtcacagccaattgtcaccctgcagatccgcctgggagacggaacgagactgacgtcgcggttcaatacgtcacacacgattggagatgtctacaactttgtcgcagcggccagccctgccagccaggcgcgaccgtgggtgctgatgactacgtttcccagtaaagagctgacagacaagtcggcggtgctgggcgatttgcctgattttaaacggggtggagttgtggtgcagaagtggcagtaatctcgcagacttggtggagtgttctctctttcttcttgcctgaaaccaggaatcattgtttttatctagattagatacctaacatgaaaagtatgctcgagctgtacttgcagttgccagatcgacaatgagatgtaccagatctgcagagtacactacagatgatacattcatgtaactcctgcctcagcatgaatacctatatgccaggatgctagaaaactgatatattccatgcctgatacctaaaccaagctatttaaaactgtgcggtacctgcttcatcgatgcttgtaaggcaaggtcattgaagtcctgcctcttctacgccgcttcgacaaaaaaaaagaacggactcaattttatatttgcctgtcgacaatccaattccttcataagcattatttcttgttagacagatatggacatacggagtaggtacaggttatacttcgtagaaaatataatccgatcccattattattctgccagcaaaaccccccaaggcggtatcccctcgcatcaagacgataccatatccagtaggcggtatagtatttacactagccataataggaaataacacgtgatccagaaacctcgcgtcgaaaaccctggattttggcacctcgccactctgccatttgtgtgtactgagtttggacaaagtgaggccttgggtctgctgctgggctcagctgggctcagctgggctcatgtaggtatggcacctgcctcaggtgtctggcacataaatgcacaaacattattgtgcactggcactgcctaaatttagtacctagtggacctgtcaagataataataataagcttttcaaagctggaatataactgctctgtttaaataaacattacgataaaagactccatgttctaattaactcaatcatttaccagattttcgactttatctcaatccatcatttttctgacttgaagttattttctctgtgcaggcattggttgaggaagctttgactacctacctaaagctaacccctagcgcgccaagctcagctacttacctatcctagcttccctctgctgggcttgccgactataaatcatctcgtgaaacctctgacgacgttggtattgtcaattaatatttgtttaggtgtatagttctaatcctaatggatatgatgatgcactccctcccgacattaagacaatgcaccaccactatcacaggatgctacaaacaagggcaatatcaggctcaaagtctcctccgtgatagctacaatattagtgaagcgacaaattttatggttaaaatggtttttagttattttccacacatgaagtcatttcgagtcttcgaaccaccaatcatttattccaaatcagtgaaatactcgactcgagcacgcttcatctatctatacagcacaggaattgaccgtctatgaacataaacaaaaatgtcgaccaaggaaacagactttctccactgactgaaaccacaaatttctcttccaaagagtccaccgatctcagttcgcttaggaaatgagatgcttggccttcagaacttgacccagctgagccagctcatcctgagtcaagccagtgtacttaaggctcgcggatcccatggggataggaacggcaccgccgtattgggtagggtggccggtaagcacagtggccagatccatgcaagctggagggacgccgtcggcttggacggctacatcataagtcagtcatcattttttgtcatcggatgaattgttgggaaaagacgcactgttaggaggcgttcccgtcaaagtgatatgggcgcccttgagctggtcctggcactgctgcacggattgctgcgacacgccaggagggaggttcgggatgctctggcgtttgtgatggtttgaggccgccgcgccgataccgccagcaatcgcaccaccggccatggaggcgaggccgccgtcggcagcggcaagagcaccttcagcagctccttcggtcgagaggaccccgagagcgcccaagaatgagaagggcgcggggcagaattgcaccaggctgaagagagcaccggcggagagggcgacgacggcgaaaggacgcattttgctgtcgtttgtatcgagcagagtgcttttgtcgcaaacaaagtaagatgtttcgtcaaagaaaagtcgatgtttggttttattgcaagttcgctgatgttgtctggattgattgatgatgttcaacctcgagaaaatggatgcttatataccttttgtttgcgctgcgaggtccgtctccatgaagctatccatctacactctgatcctcatcaactgatcctgattacgagtgtttcgggccgattggggccatgttggtatatccacttccatggttctgcccgtgagcgactgaggccaacatgatgaggtgatgataatcgttcagcagaacccatatggcccggaagattaatcgagaaagacgcacaacatttcgactatctggactttgagcgttggtgccagcctacgagtagtggaagcattctttatcgaagttaagcgagaatcctttcgatccattgtccccactggcaacgatgtgagatggaggtgattgggcatatctcctgggccctactatgttgatatactaggtgcagggccttccgcgtcccctgcatgttatctgatacagtttgaggtgttagattacttccagatcgagtggaggcggatgtgcaggtcaacagacgatctgtgctctcagagccaacacatgacggtcaaatttcccccacaaagagacccgtgcagctgtgccttaaggttcgtatgtggcgtctttatggttagatcctgcaatggatgtgttatgcataggcattttgttcgcgtaagatgatcgggtatagccgaatgggatcaatgatcaacatcctgaaaccaacacacaccaacggatggaaaacggccccttcttcagcccgtgttccttattgtttgacgtcacgatgcagcatatacaaggggattctatttcgacgtcaatttcaaggatttttgcggacacagagggaattggatacaacacgtctgttctagttaaccactcgagaactggaagattgacatttctcgatctatatacacgtatacccctataaaggatttacagcactattcgagtgagataatatgggaagctcactccaccagaggaagacccatgagatcaagaccaatgatgatcaaaaatatgtcgagattgagatgaaacagcccgtgatccacctcccgaacaccatccaacatgacatcaacgatgcaggattcttcccccacgagcaaggacgagaatcctatacctctggagatcttcccagcagttggttagggttacggaccccaacgggcgatcaaccaacattatacggtcaatatcgtagcgaagagcttcaccggtatgactttttatcttctaggtcaatattcctccttgttctcgtcaatataaatagccctctgaatacaagccctctgaatacaacaacgccacacatcctctcgaagcaagattctccagtccttcgaaacacttctgtcatatatctctataacccaagaacaaaaaacacatctgcataaatcaacatgagagtcgctgccgccgccgccgctgccatctgcaccttcttctccttcatccagctgacgcccgctcccgtcgcggcggtcgccgaagtcatcgcgggtgccctccagggaggcatcacgaccttcacgggctccgttctcagcgctgccaccgcgttgggcgtcaaaggagctgcggggcaccacaagcgagacggattcatcaccgtcgaccctcgtgggaacgacccgtttgcgaacctgccccagcccgcggccgacgagtgcaagggccagctccacggggcgacgattaacttctcgccgctccctaacaacggggtgcagatcgatggcgtcccgtcggcctgcatgacgctggccactgtgttcctggggaccaatcccgagggcccggcgcctactcctatgggtatgtatatcgaacttgtccttgatgtgtaatcgtgatgtactccgtataaaaagagacaacaatagtgacgtttttttttctttcttaggatcggcgagcttggcgtatcataacctgagcaatgatgagctgaaccagctgcaggctgctttgaatagcaaccagggtcactgagggagctgaggcctacgggaaataggagggatagttgaagaagtctattgagtttctgtacagtatttgtgttgtcttctgtccatgttgagccttgggttgtaaggatgagaagcagggagggttcttggagatgtcgatagattattgatcatagagtgaattccttccaagaaacaatcgcttatgataaaagaaatccagaatagatctagataaaccaaaaatttgattgttttctatacatggtcaaatgaattaaccctaaccgtatttctcgataccccgtgacatggcgtgtatgagaagttttctccctttttgatacagagagccactcaaggacgacctaagtacacaaagcaagcagtagcagaggcctggctgcagtaactcggtaggaggatattcgatttttggtaactcggtacggtgtacaatgattgatgagtgacagcgacagtgatgagtagtcggaagcgagcgattatcccttcccgatggggaaatgtgttggtcgatcgtagggctgtgccgcagctatgatgtcgagatgcatggggctatgagtctagcatgtttcataaaccaacaacatccccctctccggacccctcattcatccattgttattattagcattatgccggccgtggccaaagcacgtcgcttggttagtggcctgaagtcacagcctcacagggcattattcggacaagggcgcggaataaccccctctcacctttcattcattctttctccatcaaaaattcatcgaatacaaaacatgttattcccacacaatgagcggtttgagcggtttgagaggttttatacgcaccaaagacccccaaccaccccctcaccccattgccctccgaccagagtatatcgctgattgcgataccctgctctacctcaccccgcgaggcaactcgcggtcggacacgaactataccgtcacagatgagtatgaccgcgtgaggttcaccgtcagcggccgacggtcgagtgaccgcgagtgtcgcgaattccgcgatggctcgggcctaccactctttgagctccatcacaagattttcaagaaatacccgtatgtggtccgactgccaggctgcgatgacgagaacaatctgctcaaggtttctccccgacacctttctgcgctctgcaacgtggaatttcagaatgccgccccagcaaggacgacggacgtcaagaatcatcaggaagacgatgccgataaaacggtcaaactggtggtccattgcaagaatgcatacgccttgcccaactatgaggtgatgatgggcgatagggtggtggccgatttccgggagagtgtagtgaagagcaagacactgacgaccctgccttgttcccatcttgagaggccatatagaccccggccaatcctcgatcttcgggtggccgagggggtggatttgtctctggtaagtaggcttgttcatggccgacattggtgatggggactgactggttgggaggcgacgctgattgcggtggttgcgatggactggatctacggcgacaagtaatgggaacgaatatgtgattgacgacatgttagctttttcaaccgtattgttaattttgtgtatttaaaatggctacgacaatcaggttgaagacaactataacggtattcgagtcaaggactgtataaaacactggaattatccgagaaaagaatggcatcattaaatgtacatacatacaggtacaatacgaatttcacatcaaaattcacaataagaatgtctctgcagacaccacttcctctattcctcctccttcaatcatctaagtattgcataccgcacaataaccccgacaatagcacccatagctgccccgataaggatcgcgatcagcgctctcagaagtcggtacttccacggcagttcccgccatgggaccacgtagatattgatcttttttttcgcggtggatctgaacgcaatttgagggatgaagagctgtcatatgggtctttgatttgtggttgagacattgtgttttggtttggtttgggtactatttcacggagacattaattaataatggcatcgaactgaagtagagagtgtgagatatttacctcttggatgtagactgcagctgaaatgtctttgattatttctctctctttcttttttttcttttttttctttcttttgaaatggtagatgaagtgaataaaacagctgctggtctatattatatgcccttatgaatgcagagtagggcacgacgtcataacccttacagctatccaacgcataccacaacacatactttagggacattggctactgtctattgccgatcacttggcaagattgtcaatcatgctgtactctgtagtggactgtgttgcttgtcccccaccctgttgccccgcgattgcgcactgccactgaatccaataatgcttaatccaataattttggttgagatgccacttgggggcaataacataaccttcgctaaagatagtaaaacctgaacaacaagaggaatgtggaatataatggatatcacaaagaaaagaaaagacatgggcacgtgaatctttaatatgcatgaatttattactctttcactgcatcaacagagatctatagtgcaggatacctaggaagacaaaagctgaagggtgtaggatgtcaaatacggaaatctccaggatgctagaagcattgaatcagagcaggtatccagggtatgatgggcaggtggacaagccaggtgagctggagggaattcattgagagacactgcacaatgtgcaggcatgaaaggagactggtgtaaaatgagggttgaatgggaaaacaggcgatatagccagctgtgtcacgggcggatgccctgaaacggaaggaggtgctggtgtaagttaaatcacgtgattctgctttacatgaaccaataaaatgatacaaaactattaaccaatcagaacagaaataatcatagtcacgtgatttatttctaccaatcgcatcaaagtaagggaccagaggggtccccgtgagtcaaaacaagctttttcaaaatcccccagttagtgtggataattccttaggcatctacatatgtataattgccgtggctatggcttctagaactcactcgtattcgtcggataaattcaaaatgcatcaggggaacgaacgacaacgcaccgccaggcagcaataattaaattgggataggatcaacgaacgggggtgaatatatcctagatgtacttgtatacaggttgtacttgatctttgatcttctaatctgtcagaggatgatacctgagtgatattaaacgacatcatacttaattcttctgtctgtctgtctgtcttttccttatattgctataatacctgtcttcactctctttttgacactctattcatcgataccattcaaagaaccgattgatacatatcaaccatgacatcaaatccacccgcaaagcccctcatcgcaggcaaaaagatcatcgtcgtcggcgccggaatcgccgggctcgcgttccctctggctctgcgcagacaatggccagagcagtacgaggcggaattccccttgatcaccatctacgagcgggacagtcgcgagaccagcattggccgcgagggatactcgatttccatccgcggagacccgcttgcgggtggcatgcaggttctgcacaggatgggtctgctggagcagttgctctccgtgagcattacgggcaagcctgacgcgcgtgccgatggcggtgactctggcggattctgcctctgggatatcgactggaagccacttcttcgactgacgggtgttttccaagacaaggagttgcctgccccctcgatgcggatcaagagagatactctgcgacaggtcctgatcgaggcagttggcaaggagttgcacgatggtgccatccactgggagacgccgtgcacaaaagtcgagacattgtcaaaggataataaaagggtaaaggtgcatgttagcaagaagagcaaggaaggctcctctgagccccaagtcgacgagtgcgatatcctgatcgtggcggacggggcagggagcaaagtccgcgcgcagttccgcccgtcagatactctgaacttcactggcatcgtctgcatctctggcacctcgcgattctctgaaggaaacatccccaagccgatggacaaggactggggcggcgtgctcggtggcggcggtgtcgggctcttcgtctcgccggtcgacagccaaagcgcgctgtggagtctgagctaccgggcagatcagccccgacagaggatgagaccgcccctggctgacgaccaggtccagtctctcctccaagaggcgctggagagaagcaagccattccgcgaaccgctgcaaaccatgatcaaggccaccgatcccacgacactgatggtcttcaacgccatggacaagcagcccttcaggcacgacgcaaagtcgaacatcattttcatcggtgatagcaaccacgccatgagcccctttgccggcaacggagccaacatggcgttgcgggatggctggtaacggcgcagcaattgtgcaagcacacgtcgggtgcgtcgtcgtcgctagacctcggtccggctctgaaggcgtatgacgagatgagcatgcctcgctctgccagagccattagtcaatcacactggagcatctcgatgctccatgcgacgggcgtcaagctgtgggcttacaggctgcttttgggagtgatcagggtgctcaggcggtggtttgcgtgagggtgtaatcggtcagtttccaagagtcagtttccaagggaacgaaaacgtgggttggctctcctctcactttattctgtacagtatgtgctatgtgtatatttatgatcgtgagatatgattcccatctcttcagcaatgcacatatatgcagtaactcacttctggcatgggttaaacactcgcaaattaaggaatagtactcgagctcgacaccactccaggggtaaaaattctatggcgagttggaacaggagataatgacttgagcatgtcctgacatttcaagagatcaggtgacctcatgaacgccggtgaggacgaacaacagttctttgtattgcagttaaaaataaggtaaataaataaaaaaagaaatagataaaccaataagcagagctagaagttggggaatgcagaatcactttactaatgagagttgatgatagcacgtaaattgattagcttgagggcttcctttacttttatgtaatgtgcagtacaggatttactagacaaaatataatataacttttaaaataagaaaaaagggaaaaaagaaaaatagttaaaaaaggaataatgtgcttatgccaggatagccagatttcaagatatggccaattaatgcattgtcaactgttgattgttaactaattgatgatgattgataagccgttcttgcttgataatcaatcaatcggcgatgacgcagaaacagcttgcttttcttgaaattccgcgctaagcaatcatgtcgcccgcgcgcccgctctctccaatttgacgaccagtcgactctctctcatgacactcttgcacgggcaggactaagaaaaaaaagcatttgtttgaagatgcctttggacggcgtcaagaatattgtcctggtgagttttgactctgcgttcttttctcttcttcctggaaaattccggtttgccccgcgaatcttatcgataacagggaaggaaggcatctaccttttttttctttcttgttggattgattgtcctgcgcgaactcgatagttctttgtactctgctctcacatttagaagtactatatgatttgaatcagaatacgaggaattgactgactgagcggaattacgatgacaggtcctctccggcaagggcggggtcggcaagtcctccgtcaccctccagctggcgctggcgctctcgcttcagggcaagtcggttggcattctcgatgtcgacctcacaggcccttcgattccccatcttgtcggccaggagaatgcaaaaatcacccagtcggctcggggctgggttccggtcgtcgtgcacgatgcagaagagacgacaacgaacggagaaggggcagcagaagaacaaggaaccacggagaataataggacatcgtcgcgcggttcgctccgatgcatgtcgctcggttttctcctccgtgatcgcggagatgcggtcatctggcgtggtcccaagaagactgccatggtgcggcagttcctgacggatgtctactggggcgagacggattacctgctcgtcgacactcccccgggcacgagcgacgaacacattgcgctggcggaacagctcttgaccttatcaactacgtcgactgctactgcaccacaactgcctcgcttggctggcgccgtactggtgactacccctcaggcgatctcgacgtccgacgtgcggaaagaaattaacttctgcgcaaaaacccggattcccgtgctgggtgtgattgagaacatggcagggtatgcctgcccgtgctgtggagaggtcagcaatgtcttctctcgcggcggagggcaggtgatggccactgagatgggagtccccttcctgggcagcgtgccgatcgatgtcaagtttggcgagatggtcgagagcaaaaagattgagggcgataccgacagtctggatggcgaggaggagatgcaagaagctggcgagcagcaacagcaacaacagcagcagcagcagcctgtcgaggataaccggctcctggttgagaaataccgggattgtccgtctcttcccatcttcgagggctttgcaaagacattattagggaagatcgagggcagcggacaaagctgatcccgcaatgcgtcgttggtgttcgtcttttgccccatctccaattcgtggacgattcgaggacgtgctggtgccgcgtccggtggttgcgtctatgctctttttgttcccttacaatctcgtatttcctttcttttctgtcaatgcatacatgcatggaatggcgtccatcctggttatgagaaaaacaaaattacaccggctgaaatattaattccattttgttactgtcatcctcgaatgtatcgataccagagtcgattcgatagctggctgaactagtagttactaactagttagaaagattccaaaacttcaaaatcggtaacatccgtcatgatttattcattatcttcgtaaggagagatgatgtccattaaccgtgttcgtaagaagaggcgtgagaattacatgacattgcaaccatcatatccatcatgacaatgtaagaaggcatggaagtcgtcaaattcgcatcagtcgtcgacgtcagaaatcgttatcaaggagacatatcatatgttcaagaagttcgaaagaaatatcgttaatgaatatatatatatatatatatatatcagtagatctcgaaaatcgtgattggtacggatgagaaaatggattaaaagggaaaatgaatgcgagaagcaaaagatcagaacgttaataacgaggtcactcatcctgtagtgaccgcaacagcctgttcgtgcgtacgtagcacattggccgcgtgtcgctcgagcaccgcgcgaagtgtagtttctgcagtctctgggctggaggcccgttgcggcttttctcgctgcacgatccccttaagccaagcgagccatccctgcacatcggccatcagggacagcttatcaacccgagaaggctgaacagaggcactgccattcctgcttgtgccagggtagttagaggcggcgaggttgggagaaccgtgcgaagtgtctggaggaacagatggccatgaagaacgatttgcaggagcgtccacatggacctctgacagcatcgccggagttacaatgttggctgcgtcacctttggcaccagactgggcatttcccaaaagagcccggctgccaggttttggttttgtagtgaattgcttggttacgaaagaagatcgagacttgggatcattgtcagaggttgggtggaccacagtcgaagaccccgacatatccggctgggcttgaacggaggaactgtcctcgtgaaggtagtgcgggctgcgttgatagccggtggcataggcggtctgtctcaggttctcaagcaagccatacgttgaggtggcataataatctcgcccatccaagagactattgtcgtcatccacaatggcgacattgtcatcagtcagtctctcactgcttgcactcgcctcttccaccgttagtaaaccccccggaggtgctcgaatctcgccaaatggtgcgatatggctcccatactcgttggcgagactcagtctgcttcttccacagatttccgcaattgaatccagggtgctcctgatctcgggttcaattgcacgcagaatcccctcaatgctaaagtcctggactgagggcaattctggcacgcgctgctgctgcgtcgctgaagcggatggcatggtggaagacgattgcgcctcatcagctgcatcgggatatgcccggacaagcactggctgagaggccaaagtcgatggtcggccaccaatggacttggtctcgcggtgtcttcgtgacagaggcttagaattgccattcagctggcggaaggcagtggttcgacgtgccagggtcgactcatccaaagcagatcctccgtgacggaatctcacctggggtgagatactcgccgcagggggcccagcggggtgggaataggatgcctgaaaccagttctggtgggggagggatgaagataatcgaggtccatcagggtgggtcggcgtcaggtcagatctggcgtccatcttgtccacgtcctgccgccgcagagacgcagcaatatgcgtgcagcgtacgcgcagtcgaatcaacccagctccgaaccgtttgaaacgacttccggcgcgctgcagtggagtacaggacggccacacgcgagcactgcagtagcacgaggaagaaatggcgaccagtaggcaaattgaaaatcaatcagtcatccacctacggaggcagcaaaggtcaccatgggcgatgacacgccagtgacccgaagcggacagcggggtccaggctagactggttcacgagcaagattgcatgctgagctgcaggagagctgcactctctgtggctccaggacaaggggcgaaacaggctttgttgcgcgaaacacaggatggcaacccgaggtgcagcagggagtgagttggcaagcgctgagcggtgggcagagggagagttcgcgagaagtcgtcgagcagatggaggggaaggcgggcgaaggcggagtcttagctcgccaaccaaccagctggacacttccgcagacaacacgacgctgcaggcgttggacagctccatcacgcgggcttccacgggcgcagatacgccgatacccacgatctgtgatacaaaggcaaggcatggcaaggtagtcttcaaaatgagcaggaattatgtatgcgactttggtttcccgaccgctctgatttatccatggattgaccgtcacctcgcagtttggcgattccgacgagtcgggctctgacttcgacgaagacacctccggcctccctttccccaagccgttgtctcgatcatccttcctggcccccgatttcgacccggccacctttctgtcgtcgctgaccaaccgccatcagaccctcgaggacttgcgacaggagctgcgcgacctgagccagactctcaacaaggagctgctagatctggtcaatgagaactaccaggactttctgtcgcttggaagcgctctgaagggaggggaggagaaggttgaagaggtcagagtcggtctgttgggttttcagcgggacgtcgcagccattcaggcaaaagtagaagcacgacgcaaggaagtggagagtctattgcaggagaagaagaagtgtcggacgcaggcgaacatcgcaaaagctctcttggacattgcagagcgaatagaagagttggaggagcgactgatgattggtgataccgcaaaacaaaatggacagccatacgaagacacgaatccagatctcgacaccttcgagagtgagagcgatgacagtgacgacgattttatggatgactccaacggggcggccgtcatatccctgaaaaaactggagcatcacattcaaaaatatgtctacatcatcgctgcctccgatcgaataggcaacagacatccattcctggtcagccagcagccgagacttgagaagatcaagtcgactctactgcttgatctcaacacggccctagaacaagccaaaaaagccggagacaaacgagacgagcggacactaaaggtcatgcgactctacgatctattgggtgccgagtccagtgcggtctttgcactcaagcacctgacgatctaaatagcgagacgatgggtcggttttgtaatttttttttcgttgctggcttgcatagcgccggagttcggagttcgggaagaaaaaaaagggacggttttcaaattgataccattagacgccgtaaatagaagaaacctatataactaacacattgcatacgaaagatacaattatgttacagtcccgtcaaagcttccgggtccggtgaattctccgacttgaaatccccgttgagactgaacccgggtccgttggtcgaactcaacacctgacaacaatatcagcttcactagtcgccgtcacgatcgtgagatgagcttgacttaccacctcgtagatctccttcgtgatgcggtcgctcagctgggcagcatccttcttgatctgctcgatggtcgtacgcagattatcccgcagctggtcgggcgagaatcccagctggccaatgggcatccggatcactccatctctctcgcggtagactgtacctccgcgcagcatctggaccttgtttccaacatcatcgaccacagtgcccatcttcacgctgggcatcaagcccctgggacccagatatcgacccatgccggccttgttcatggcatcaaaactgtcggtatgacagatgcaccgatcgaaatcaatgacgccatttttcacctggtcaaagacttcttgctctccaaccagcacggcgcctgcttctttggcttccttttcatgtttcgagccaggtgggcagatgacacagattctggattcggtgacggcatgagggaagcggaccatgttgcgaatgacagggccatccttcttggtcttcaatcgaatgtgaacctcatatttcgctacttggcggtcacggcctacttcgaaggcccggaggtatctggttgagcagggtgttagcctagaaaccaccgcgccctgagaacaccatggacgaaatttgccaacctcatcgcatcacagagtgagaattgcgtaacattcttcagatccttgtactggtactgccgagcacgatctttcttctttggcttgtcctttttcttggcctgcgcattattcttcgctcctcggacctgctgctgctggagcggatagagaaacggagcaattggagatttttgccgcaatggcgacctgcaggacaggatcatgctccttgccactgcgggcaaagaagcagtggacgacgccatgaggacgggcgacgggatgatggagtctgtcgtactcggacactctgacagtctcgaatgttttctccgagctcttcggagatggccggaataacatagcgccgaccgcctcacgcgacggcggcggcccgccgcttagtcatccatttagctcgtcttttctcttcccgggagtcagtgtggggttccgtctggaatcaccccgccgaacagttcaacttttctgttcattatttcaccacaaccatcgtcactgcagtccactatgtctgaatttcagctggtcctggcgtcgggtgccaaccctgccaccttactccctgttagcctgcttgcgacctccatcaatgaggcgcgaccaagccctgtaattgcaatccgctatgagaatgcgcccgcccttcctgatggagacaatgctacagtgcaattcactggagccagtggtactcctgtctatgggactgagaacgctataaaggagatccgggagactttccctttcttgaaggggcaaaatgagtccctggaggagtcctggctttctcaggttaaccaatttttcccctctgatttcaaggcccttgagcctcatctgcagcggctggatatgtatctcattctgcgttcgttcctggtcgggtactccttgtctgctcccgacattgccatctggggcgccattcgaggcaaccgtgtggccgtcgctgcgatcaagaaggggacattggtcaatctgactcgttggttctatttcctggaggaactctgcccatgggctgcgcctgcggttgaggtgctgaacgctgcggcgagggagaagaaggctgctaagtctagggagggtgccagctatgacattgatctgcagaacaccgaccagggtgttgtgactagattccctcccgagccttcgtaagtctatttggatcttccgtcgaacacagattaatgacttgtctgtctaggggttacttgcacattggccacgcaaaggctgctctcttgaacgactattttgcacatgaaaagtacaagggcaccctcttggtccggtttgatgacaccaacccgtctaaagagaaggaagaattccaggattctatcatcgaggacctggccttgatgggtatcaagcctgacaagctgagttatacgagtgactacttcaacgagctttatgagtactgcgtccaaatgatcaaggacggaaatgcctacgcagacgacacggatagagagaccatggctgctgagagaatgaagggaatccctagcaagcgccgtgatgccacggtcgaggagaatctggcacgcttcgaggagatgaagaggggcaccgaagagggtatgagatggtgcatccgcgccaagatttccgtggataaccccaacaaggcgcttcgggatcccgtcatctatcgctgcaaccctacgccccatcaccgcaccgggaccacatggaagatctacccgacgtatgacttctgctgccccattgttgattccattgagggggttacccacgcgctgagaacgattgaataccgcgatcggaaccctcagtatcagtggatgcttgatgccctcaaactccgtaatgtgcagatttgggatttttcccgcatgaactttatccgcacggtcctgtccaagagaaagctcacaaaactggtggagaaaggtgtcgtctggggctgggatgagtaagtagtgccttctgtcagtaaagctctatggactaacaaccccaacgcccgagaatgccaacagtgcgcgggattaggaggcggggcatgactgtgcctgccctgagagagttcattctcaaacaaggtcctagtaagaacatcatcaacttggactggacgctcttttgggccaccaataagaaatatattgaccctgttgcccctcgtcacacggctatccttaagaaggacgctgtgaaagccaccgtcaagggcgcctcagctccttacacggagaagaaaccaaaacacccgaagaaccctgatgtcggtttgaagacagttgcgtacagcagctcgattattctggagcaggaagatgccaagactttcaagcaggatgaggagattaccctaatgaactggggcaatgcgtttgttcggaagatccacactgatggtgacaaggtgaccgaactagagctggagcttcacctggagggggatttcaagaagaccgagaaaaagatcacgtggctttctaccgaggcacagcagcttgtgcctgtcgagcttgtggactttgatcatatcttgaccaaggattccctgcaggaggaggacaattttgaagacttcatcaaccccaatactgagttccgggacgaggcttttgccgacggcaacgtggcagagcttaaacgcgatgacatcatacagtttgagaggaagacatactacagagtggataggccgtatgctgacggccagcctgcggtgctgttctgcattcctactggcaagacgaaatagagccaggaatgacatagatgggtgtctcagactattttaggtcaacaagagaacagggactatacatcagatacaatcaccaaaatgcgaactagtcagtcaaattagtctgggttgatagagggcgcagttgataccaactaggctagggcatgataggtaccataaggttctcggaacctccgtaaaagttggtctactccgcatttttaaacttaccacatgaaactccgtactaaagaagggtccatgatgcataccttctaggtataactgcggggcttcatgccctgtaagtttgggtgcatggagaagtgttctagagttctagaccataaggccttctaacggcgaacaactcttaatagttaacagtaatcccctacggaaactcacagtcaaagccaaaaaggaaaaggagtgtaagttaccgacatgacaaggattctgaaagtgccgaggctggttgccatagtcgcagatatattaatattatcaagtacctagtaggtaatattaaaatcaaattaagttaggatcggttgagtttaatattattattgggtgccaacgtcgtattaggtagctaagtagtatatccaggtcctgtacgtactcgtactcaccatctagatccaatcagcaggaaagtgtacagggaggtagtaagtgatcttcacatgtcatgtacctcatttttggccgggtttgccagagaagcctaggcttgactatagtgcatctcatatagcaggctgagctcttgttttatggctccatagatttgaatattgacagggttccccgcattggttaccattttactccatttgaatctgaataggtagttggtggataaagaagacgaataagtcgatggctaagctctaaacttctggtcttgatattgtcagtttcacaagcttgaagtcagtgccgaggtaagctttggtcctgtcatatcatgcatcccccctctcctcctttttttcccctcttcaacggtagttctggaacagttaaccaactttatctgcaagacatgcacgccaactagattgcattagtctcctgcttttatgtaaccatgaaccgggggtcgatgtcgccatagatcatatttccccggattttcgggcaaaccaagtctagaaccttcatcatcttcatcctcatcgacatcgacagggataatggtgtcatgtatgaaatatgcagcccagaatcacctgtgaatttatactgctggccagatgaaactgttaccatcatacacaacggagttgttcctcttcttggatacttattagtcaatgaattgagtaacagggtgaggaaatgacggaatagagggatataaaatggtgcaattttccatctgtaaagtttctatcaagtcgatagtcctttgagaacgcgtttgatattgataaatacttactgtgtctatcttgacgacctccttctcctatctgcataaatccagtttaatctgtcattgaaaatgtccatcaagtccctcgtcgtcctatttctcagcttggcagctgccagccctttggccaagcgcgacgctgccaccgttctcgctgatctgaacaccatcagcactgatctgtcgaccttggacaccgctgtccaggggttcgatggaaacatcctcaatgccctgcccattgctaatgatgagagcaccgtcgaaaacgacctcaagcaggcaatcagcgacactgatgcgtcgtctgcatttagcaccagcgacagttccagcgtgacgagcgctgtgacggccctcgagcccagcatcaataagacgatcaatgatcttgttgccaaggtatgtactgactagaagcgttgaatacattagcgttgtatcttttctgatgacattctttacttacggttgacatttctagaaaccccaattctcatccgctggcatcaccagtcttgtcctccaggacctccagtcgctccagaacctgaccgacacgctgtccagcagcctccaggcaaaggtgaccccgtcggacgccagcaccatcgcatccggcacgactgctttggatgcggcatttgcgagcgcgattgcggcatactcttgaatgatgatggaagacagccaggaatggtattattgaggcggattaactttggcattcagaatgcatttgacgtgaaaagtgcagaccaaactatgagttatgtctgagcttctgtttgagtaactagtaagatgtcgattgagagagtcaggaatggatatctcccttcattttgattagcaatatgcttgggatcggtcgttccatgtgtacttagccgatattgtcaggatgttgtttccaaagtgatgctgctagctttctaatactcagcagtatacagtgttgcgcgaagttgttccaagtgatcttgctacaaatagaaaatattacctgattctgtgttggggcctaactctacgatcagaatggcaaatatcgactatacctattccactatcctaagagagacctagataaagataatgcgtccatgtaccgtacatagccttatctcttcgtgacacagcaatgcttgacctcccacctgcaactcgcttcgtttgccatgtctgtccagacgaccaaccaggctggattgcaatcctcctacatccctgccccacctcgccatcaatcagtaaataaaaagaaggctgctcagagcagcaagcttgcctttttttttttagtaggtacgaatccttagattctaatttaatcccccatctctgtcaaagaaacaaagctattcattagtttcgttttcttctagaggaatattccagtcatggcgtcgacgagatacctttccacgacagttgtcgtcgcactgctgtttctggttcgtaacttcgaactacccatctacctgagatcctggttattccttggctgacacgactccaaatagtcaacttgcgtctctgtcattctgggctcgtgagtcttccctttcttagtctgtgacattgctatcgtggataatcatcaacttctgaagacgggagccaacaatcgacagctggaataagacaatacaaccattacaagaatggctgacttttcttcaacgcaacagcattgcctggtctcgctccgtctccctcttcctccccttccccgtctctctcagtgccagcgggactcttctgcccgtgctgactatcatcactctcctgacgactaacatcgtcctctcccgaagaaatcgaaagagaatcactgctagcaatggcactagcacaagcaacaacaatatcaacaatgatagacctgttacccaatccagtaccacaaccaccatcatcaccttcctcatcgaccaattcttcactctcgcaccagccgtcatcgccacgctggcagcaagctacatcttcccctccggcagcactgccgatacctgccatctcgaagagacatggcagtcgtacttccgggccaagaacgcagacgccatccgcaccatccaggatgcgctgcggtgttgcgggctgcgaagcatccacgaccgcgcgtggccattcaaggatgcgacgcacggcgacgatgcctgtgccgtgcaattgggataccggcagagctgtctggatccgtggagtgaggttgaaaagagcaccgcgtggatggtgtttgtggcggctgcgttggcgtggttgatcaaggttcgtatggacaaatccaatcgtcgtttacgatcaaattgcacgtttattttatttctttagttgtttgcttgcatgagacttcactcttaagcatgaacccaaaatgatttgtccatgattgtgcatacgtgaatttctcactgacgacatcaaccctcaatcaaactatccagctcggcctaacgcactttggaccactacacggaaccagtccgtttgatttacccagaggagaaaaccaatacagaagtaatctctggatcaacggcatcaacgggtcctcttccatccctcgaatgctcccttactcggacgtcccgcatgcagacgagcaccgcgaagacgaagacgaagaagaaggaggaagaggtaacagcaacagccacggcagacagaatgcagataatgacggtgagaatcacgacaatggttataataatggtcaagggaaccacggaacaggaacagtagcaggagcaggagcaaggccagaatactcggactcaagtccttggagagaagaataattgtggcttcgttctcttgcaatggctactgaatattttttgcaatgcaagaagctaagtggaagcgccagacacctgatatggaatgaacccattgattcgtggatgagagtgttatgtatcagggatacaacaggttggtaggattgttcttgggttcttggggtgcaagtatgggtctgaaatctattgtgtgtcgtgtgcagatggatatggaagatgagctgagcaattttttgtctccattcctttcaattaatcatctacagaaacagaatgctgtgctttaaaggttataacgataggatctaacgataccgctcattacaagccgtgtccgggcggttcggttccagacaattttaaaattcagggttcttctttggatcccaggtaatgtcgagaattccttcagcgtacaacccggtaacaatgagacgacctcgcttggagtccatatcgcccgtcgtactgctaggatagtggtcgccatcacctataaaacacattgtcagtgagaagtttgtattggatcaacggtaaaagcgtggatatactttggtacagagtccgggcacagtatttgtttttcaaacagaacaagactgcaggatatggagccgggtctcttccatttccccgacgaatctctgccacgatggacggtgctttgcagccattagcgctcttggccatgcaaaacaatctcccagcatctgggcaaccggctacgacaactccacgcaggaaccttccatttgcatcgaagaccgtcgggtcatccaaacgcaaggaacagtcaaagctgagattgtccgggtgaaaagtcacccggattttatcgtatctgctcgacagaacattggtctccgggtcacgctcgtagatgcgaacgcagtttgtactagtggatgcgacaagcacttgttttcccgtcggggtgatgactatgccattcgcaaaagggatccctccagcagcaattgtacataccggtgtctcccgagctgcaaagtctacgaaggtgacccaaccaagaggaagcgccagggcagtttcggtgtaggcaaggatcgggtgccttctcttgatcaggtagtggtcattcgtgacatagaaggaagtatacgagactggggcgacagcattgggggacaagatgctgcgatcaccgtccgaaatcgaggtaacataaattgctcgtgctgattcgtagtcaacatccatcacctccaccgtgccgccgtcgcggcgatggttgacgacaaagagccggattcgaggatctccaggggtgcggaagaagttgattcccaaaggatgaaaatctgcggttgttggaaatcctaccagctccagctgccggatgctgcctgtggacgcatagtcatacagcagaagatggcccctggggtttggatccttcaacggaccctaccagtcttcgtaagcaatttgaacgtacaaagacatccgaaaattagaatgcaaccaaactcaccagtatggtgttccagaagactcgcccagggtccgagctgataatggcgaacccccgttcatggtccaacacgacatcctctgagaatttcaccctgtccttgaagagaatccatacaagacccttgtgaaacgggtgccagcgttcaggaattaaagggaggctgatccgtggtgcaagaattttgtagacgaaaactgcgaaggctgagagcacagctatcgcagcagcaagctagttgagtaatacagtcagtgaaaacctctcttatgaacactcctaaatctggagtagcataccttgaaataagaagcttgcagggccatttgctgagaagatcttccgttggctaggtcataatttccgtttctcgttcaggaattagggaatagggaattaggtagttaggaactgggctgtcatgccagcagaacggattgagatgatgggataaaacgaccaacatgatcctcggcgggagggcagcgctcggtatggatcgttctttcctaacagagatgctgtatgcgctccggtcgggttcttggtgactgtcgtggacgatattgtgtcgagattcctacatcaccagatttcatccagagaagcctatcatttctcttgacaagattcaactgtcactacaacaaaagaaataccccatttcgatacctatttatctaaggggtctacggtatcttatggaaaacttcgcaggatgagatgttattccaagggccttcgcaaaacgagtttaccatagccatgatgcggtccaggacgatgggtgcgaaagcaacttatagcacagtagtaagaagtgcgcgagttcaacatggacgatgttggcaggcaaggactaccgtaacgagcaatcggcaataattcctcagcgggttccccgcctggctctccccaaccaacctcagaagcttccaccaaccgtcgtcaacagtcatgaccagctgcaattgagttattttcttaaatgacactcacaagtgatcgatccaatccgggattctattacaatggttgtattactcttgccgacagacgtcttcctggtaagccatatgagctctctgcatctaccgtcccggctccaattgtctcatctggtcttcctgctcagaatctaaccagagatttttgccaaagaagatgcagtttatcggatcgtccggaaagtcaatgggcaccctcgtcggcactggctcgaagttcaacactggctacaacctcgggcctgaacggcagttcccatggtttgtcaatatcaattcctcttaggcaccgtctctgtactctacctccaccagtggcaatgattctcgacgtgaattaacttcagtgggatcggccagtcctcgtgctaaggttgacaataaagctaggctttgccaatcaccgccaacgagttcctgggattagacgctgggagttgaaggtttgctcggcttcgactcagcaataaacacctcgtacgtcaaaacacgtcaaacttaccattgatgcgtcaggacagggtcactcttcgctgcagcttcgtcccgttctcatggatgacagaccgtgggatgttggtagcctagcccgtatgggagcaaagctacatctttttgaaagcaatcagccctcatctcagaagcaaccgttgcagaacccatcctaattatatctacgtcatcatgattgaacttcaaaagcatcgtttaccccgtcagacacgagcatgtgctcctcggttgttctcactggcttgagaggggccgagagcacaagcagcaagcggccgccatgacggcgtttctcctcagcttccaaagcctctttgattttcattctacccgcatgatcagagagaacttgcaaccgaaataatactttctcgccccccttctgcgcctgtacaactgcatataggttgcaggaaggacaaatatcccttccccctaagatcggctgctgccctgaaggaaaggcctaagacaccatgtccgacagccagccacgttccgagccgctttctgagccacgttctgacgagcaacgtcctgacgacgtggaacagcagccgtcccgcgagcagcggcgctcgtctcgcatctcacgtcgaatgtcacgggcgaccagcatcgcgaacgatccgaatttggatgagtatgagagacttgtcaagtatgtttctgtgtaccgagagcctgggaaggccgaacttgaagaggatcaggagggcgagatgcggagggtatggtatgccccctggagaaagagatgggttcgtaaacggaaagcagaaggggcaccgcagttcccagaagactggctcctcaccgatatcaaacaaggcctcacgaatcaagaggttctcaatcgacgtcgtcgttcggggtggaatgaactagtctctgaaaaggagaacccaattgccaagttcctttcctacttccaaggtcctatcttatacggtgaggctctccatgatttttcttaaagtcttcttgtgtttattatctgctaacagtcgtcttcagttatggagttggctgtgcttctttcagctggtctgagggattgggtggacttcggtgttatcatcggtattttgtttctcaacgcatccgtcggttggtatcaagaaaagcaagcagcagatgtcgtttctagcctgaaaggtgatattgccatgagagcaacagtcgttcgtgagggcgaggagcaggagattcttgcccgtgaactcgtcccgggggatgtggtatggcgctctctcctggacactagtggcactgttacacttcgattaacatgctggcagattgttgttagcgagggcaccgtcgttcccgcggatgccaaagtcatctgctcctatgatgatccaaatggctttgaagaattcaagaggatgcaagcagaaggtgccttgggagaatcgtcagaagaggaaggtagcaataaggaacaaggtggggaagaacgtgaagaggacgcaaggctgccaggtgaaggggagaagaaaaaggaaggcgaaggcgaaggcaaggaggaagagggaggtgaggaagaacaggaaagcaaaaacaaagggtatcccatcctggcctgcgatcattctgccattacgggagaatcactggctgttgacagatatatgggtgacattatctactacactactgcatgtaagcgtggaaaggcctacgctgtcgtgcagacaacagcaaaaacgtcgtttgtcggacgaactgcaactatggttgctggcgctggggggaagggacacttcgagctcgtgatggagaacatcggaacgtctcttcttatccttgtcatggcatggattctcgctgcctggattggtggcttctatcgacatctccccattgctagtccaaaagagcagacgttgctgcactatacactggtgttactgatcattggagttcctgtcggtcttccagttgtcacgactacaaccatggctgttggcgcagcctatctcgcgaaaaagaaggcgattgtgcagaagctgaccgcaatcgaatccctggccgtatgtggaacccttcacggaagcacatcactttactaattggtaccaaagggcgttgatatcctgtgttccgataagactggaacccttaccgccaacaaattgagtattcggaatccttacgttgcggagggtgtggatgtcaattggatgatggccgtggccgttctggcgtcgtcccataatatctcggcccttgatcccatcgacaaagtgacacttctctcgctacggatgtatcccaaggcaaaagaaatcctccgacgaggctggaagaccgaaaagtttactccatttgacccagtatccaaacgaatcgtcacagtttgcagttgtgagggggtcaaatatacatgcaccaaaggcgcccctaaagcggtcctgacattgacgaaatgctcgccacgaactgcggaattgtacaaacaaaaagcacaagaatttgcacatcgtggattccgctctctaggggtggccgtgcagaaagaaggtgaagattggaggttgctcggtatactacccatgtttgatccaccgcgtgaagacacagcgcagactatctcagaggctcagaatcttgggatcagtgtgaaaatgctcacaggtgatgcacttgccattgctaaggagacctgcaagatgcttgcgctgggtaccaaggtttataattctgaaaagcttatccatggcggactcagtggtgcaatggcccatgatctggtagagaaggccgacgggtttgcagaggtttacccagaacacaaatatcaggtggttcagatgcttcaagagcgtggccatctaaccgcgatgactggtgatggggttaacgatgctccatcgctaaagaaggccgattgtggcattgcggttgaaggggcttcagaggctgctcaatctgcctcggacattgtcttcctagctcctggcttatcgacgattattgattcggtcaaggttgcgcggcaaatcttccatcgcatgaaggcttatatccagtaccgtattgcgctctgcttgcacctggaaatatatttggttacatcgatgattattctgaatgagagtatccgcacggatctggtggtctttttggcgctctttgccgatttggccactgtcgcggtcgcctatgataatgcgtcgtttgaaatgcggccggttgaatggcagctcccaaagatctgggttatatctgtcatcctcggcattttacttgcagcagcgacgtgggtgattcgtggctcgatgttcctgccgtctggaggcatcatccagaactggggtgccatccaggaagtccttttccttgaagtggccctgaccgaaaactggctgatttttgtgacccgcggcgcggagacttggccgtcgctggagttggtcggcgcaattatgggtgttgatgccttggccaccatcttctgtctgtttggctggtttacaaaccaaacaatgaggacgaagcctaaggactcataccatgagaccaggaacggatggacggacattgttactgttgtccgaatctggggttactcccttggtgtcaccattgtcattgcactggtgtactatatcctgaatagggttgagtggttggccaatttgggtcggaagaagagaagcaagggagacatacagatagagaacctgctcgcacatcttgcccgggtcacgcttgagcacgagaaggaaggggaacccaagggccggttttacctcgcggccaacaaagaggaagaagaggcggagtaaacctgtcgattgtcgaatcatgatcctgtatctctgtggtgttttccaacctacggtgcgagttacgaagtgtgactggggaggttggtggtcagcggagatgctggctccattcaatcttcttcgcagtatgcataatgggaaaatgcatgattatggattcatgggagtaatggtggagttataactgaggattgttttcagaagggaagttggggtcgctaaaagtctgatgagaatactttaattgttatatcctaatattattaatgttacatgaaatcgaaattaagaaagacaaaaaaaacatggatcaaaatttatcagccgcagataatccatctcgtcagtggaaacattctgatcctcgcatgtgtggggtgcgggttaaaaccgttacccctcttgcgatgcgcaacacaactgcaatattattattgtcatctcattgttctctgaatctacatcagaatactcgtctgtctgggattttctctctaactgtgctagacgtgtcggaggtgctgtcctgactccatcatcatggaaggccgctgccagtgttctctcatccgctttaccacccccctcccggaacctatcaagatctttatctgccactgcaccgaatgtcgacaccagtcgtcatcagcatacagaatattagtcatcttcccttcatttgagatctcagatccaaaacttcctggaaaggacgatccagcgatcggcatctacacgcgccagaccctcacggataacatcctcgagtgcctcttctgttggaactgcggagcgcgtctgatggaccggacccctggggagccgaccctgtgcgtcaagggcgggtgtctggtcggactaaacaaggagatgatagccaaggcggcgcatgtctggtgcaaggaggcggtcgtggaggtacctgagggagtggagaggtgggaggagaatcctgggaggggatgatcctcagaaagaatgatgttgacacagtcagtataagaaaaaggacagggaaatgtcatgaagttgtgtctatgtggggtacataccgtagggtcaaaagctcttggatgtttcattccaacgtgccaattcaatcccatagtttcgctggaaatttcattcaaccaacttatgcatagaataaaatacatattcatcatgatctgatcctgaaatgggaaatctctgttacttactgtggcagatggtagacaatagatggtcgttgacaaacctcatgtaattagtaatttagatcagttagggcattcccgccctatccaaaagataacccagccacctcgacggacagaatggaaggtgtatactgacaaacattaatagactatgaaacaggtgtcatgacatcccttttgtcccagagagttatatagctatcatgcttcgctacctatctaggtgtcctccctagattgctttcccttgcctgcatagtcacgtggaatccatccatccttgcgggtgcgattcaacagaagaaaaaaaggaaattatattatgtgatacacgtatgcacctacatctattctactagatttatgcagaaataattttatcttccttcctttgtttgttgtaagtaaacgagtatgactatctggatctggcattcatacccgccaagccaaaacaaccacgagcgtaaattaggtagtctatctttacatctattctggttaaacgttcttcagccgttcctggctgctacattcctgccgtgttacttacttcctcgtgctcctgccataatgctgtcggtagctatccagttattcttgtaggcttctgcaaactgtctctggctttcctttactctgttaggcgacggactcaacaaacaggcatggtgattaattaattttagtctgcgtattaaaatcaatcctccattcaagttgtgtctccggatcgggtcagaaaccgcggtcatttccccctcatgggaatcgaaggaatttggtgcacatatacctgccacaactacaatcttaatgagcgagttcgagttcgagtcagagtcagatgtgaactctgcagtgcaggttgatcgggtgaggtgatcatcttctgcataccgagtacctacatacgtagccacatgttcgtgtgatctacatacctgacccatcctgcatcaagtgcagttgaaaaaaaaattatggggaggggagagagagctccaacgcaataccaaaattcaaattcatatgtgcataccaaactatgtacagaaagaatggaatgtaatgtatgtacatgaaacgagagttccagttcagggcaatcaccagccacatcgagccaagcgattcgtcaggcataacgaggtaacgacagacatgcacataccacaagaatatccatcctatcctgtcgtgttaacctcccccaaaacttctcccagagtgttctttctatttctccctctctccccatctcttcccgggtctccaccataactggcagatcccgagaatgggtcaagcaaaaaaggatcgatttttatggtcagttcaaaactcaaaaaggaatgtgactttgttgttatttggaattggagcagtccatgctctctgtttgtcagtccatcctccctcgagaattccttccggatcccgccagggttctcagaggtttcgtctcagtggatcgctgatttagacgtagcggcgccggacaacagagcgcatgatgcgagaagcgctgccgttcagagcagatctgattccagagaggaaaccgctgttagcgtaggcctgactggcgtcccagatcatgacgccaccgaagctggagaagcccttggcgtattggatgataggagccaggctcgagacaggctcgtagccggagccagccgcagtgggcccaccaggaacaccgaggtagaccttcacattcgggttcttggagacgttcttggcccaggtgtcccaggtgtcgaagttgaagttctgctgcgtggtggagccgggagtgaatgactgcagtccgcagtagttgttgtagaactgcacccagatggcgtcaaaggagacggtcccgtcgagcatggggttgtctgcagcatcggggtaggggcattgaggcgccgcagtcaggtagtacgtcttggacgtgtcctggtccatcaaggagcggagctggttggcaaaggtaggcatgttggacacggtggactcaaagtcgaagtcaaagccatcaaccaccgcgtcgccaaacgggcggttgatcgacgagttggatcccacgggtccaaaggtctgccagatcatgttcgcagcgtcaatggcggcttgctcgctggtgaaaccaccctcgctgtaggtggcgcctccgatggagaggaggatagtctttcccagagactggcaggtcttgatgtcctctctgattttcccaccctagtcaacacgatggtcctccagtgtactttgggtatagattcggcactcacgcgatctgcgggcagttgtaaagctcagtgcccgggaagtaggtgcagttgttgctcgcgttcgcaaagtcgatcaccggagcaccaccagggccattgaactcatacaagaaggcgagtgggtagacctattgataatgagtactccaatcgattgcgcgtgctcagtgggatgatcatacatcaatgtccgtatctgtacatcaccaacggcgaggttagccattattacgcgttgtcgtgcctcgaaacgacggtaccacttactttggcagtagaaggccaggttcttctgcgcctcggcagccgtgccaccaccgcccgcctggatggagttctgacctgattgggatccccgtcagctctgcatcctttgctcgctcagcagaccacctaccccagtagacggcaatgttggacttggtcagatcccaggcagcacgcgcgccgctgaaagaggacaagaaagcagagacgaaaagcgtggtcttcacggaagacatggtgtgtgaaggaatggcagacctgctatcgaaaagggaatgacagagaattattggcaaaggaatggaagagggagagaagacttgacgaaaggcttgctttctgactcggggaggaatgaatcaagtgaagtgaaagcaaggtctcttatttataagttcctcgacatgtgcctgctacctactgactgttgcaagcaatcagatatcagggttgcaccacgatgaagcttagctctacctttactccacaccgacgtgccaccatgacaggccccatcggcgaaccggacgcgatgagatgatacggaggcctggaatgtgatggatgtgaactgtcccctgaccatctcacgtcagccgaatggaaacggcagccggcgcaaagcttgccttccatcgccagcagtcgagatgtgccagcttcgtcatctgaagagctccagcagagcttgatgactgccgaatgtaactctacagctttccctgggcacgattctttcgagcgtgaagtgactcgcagcagccacgagaagcccaggtctagaccaagcaacgccctcgccgcattcaaggccatcaatgacatccttccggcgtcttgaccacttctaaatttcgacataggaaaggctaacaaggttaatcactagttagagtcacacggccaatgttatctcgcgtccggacgtagcttgcgcgtggtcgggcccaagcgttgcagccggcagtccgtcagcactcgacagttaattagggtggtacaagctcattgctcgagtctgcacgaggtgccaagctctctggtcgatctgatgccgatctcggtcagccaaacactgtcggggctggagccttgggtacggtggctccacagtatgcaagcatccaggaacaggaaatctccctcggaataagcgtgtcccagtcctacctcaatgatcttggtgccctcctgagacggagtccaccatgcaagacaccgtcatgcggcacctacatctctcacggcaggatttctccgacatgtcgaccaaggtgattcgcaagaacgcactgtggaggatggcaaaacgtttacaatggcatgttgaaggcttccctttgcagcgacgtcgcattcctcggaccagcgggccgctcactcctccacttgtcggccacttaccgcaatctgggggccgaaattatttccacacgtcctctttttcgatgcgctaacgatatttgtgatttgcagatgaatgcgatagcagccgtccaatattaagtcgcgaccatcgtggcagaaacacaacttgactcgtcacgggagtccctgtcgctatccatggatggagtgatggagttcccgctttgacgcccattttccggaacaactcagtcctctggaaggatttcccgaccagaagtgttttcctcttcgtgcgcactaccccatagagcatccgtcctggcggaacaaatgcctcgtttggcaaactttgggtgagaagtcgagacagccctggtcgtttcatcggcatgacattgcacgccgctaagcttagtctagtatggcacgccatatcgcctgcggggaaaaccgaacaaggttgcatcctctaagacgttgttccccaccttaatcgagataatccactatctcatccgcgtccagcgtcctccgtgcaactttccagttaccagatgttcttcttgcagtgtgcacacgacaccttggtggataataaaaccgtcatgtcgtcgtgagggatgcaaacgccgacgctggcaggcagcctgcttgcgtatgcttcaacccaactcccttatcttatgactgctgaggtggtgctggccaatgttaccctgcctgaacgattccttccgaacaagcttaattcgacctccactacggaatagaccccgtgacgaacctcgttaccgacagtgggcccaactctatcgtccttatcgggatttcgagtacggaggggaatgaaagacagagaacagacgagtaatcggaatcacaatcaaagtcctgtcccgtccttcggtgcgcagagctctggtcgttttatttcccggtctggttgccaatctctgataggggtgctgcgctgtcatgggtttagtgatagagccaagatagtcacgtcacagtcgggagtcaagcggcagcagcggttcgccgaggactaagccagttaatttgcttactcccccggtccagtgaattaaaatattgtcggtgttagagaaccgtttcatatgctcctggaattcgtttcgattgggctgctgaaaagggcctttcatgtattaaggacacgtcaaccaccaatcacagcagcccaatttcatctttgaccttccaaattggacttgtatttccctttccgtactcggttcacatctgtcttcccatcactctttcctgcagatgcatctgcattgtgcctgccttgcatcctcagtctccccagtctctgcccactgactggctcttatctccggttgactggtgtgccatccacagggtcagtttataacctctccgttgtgtccgctagatgaatcagtaggactgtccacgtgtacccgtttatctgcgataagcatcttcccgaagagtccgctatctcgatttcaatgctgcagacgtcaagcctgcaagatccacttcttgtgaccctgtgagatgtcaaatttccacattgtacaaacgctgatgacacctgcattgccgaaaggcagcagacagactttcatgggaggcaccctcgtggttccattgcatcgaggctttatccaccgctgtcacccgtccattgaatgacaccttaacgtgctctggtatgtttgcctccatgacaccaaacgagacccaggcagcggcaggagacctttgggtgcttgaaagagtcgaaatagagagatttggcgaaaagaagaccagttatcgaatgacggtctgcaacgtcaccttgccatgtgcaggttgcaaacgacgagagaatgttgtttgcctccgacaagcagatgaccagaagccctgcgttagagtttgttttcgctcacaccaccctgttgaccggtcaaagacagttatcggacaaagcaccctcatctcttgcaaccctatcgagaaggcagtaatgacaaataattccagcttatgggacagacgcttaaaagattctgaactcgactcagatcttgtggattaaagcctagatattgtccaaaatgtttcactcttatgaacaggctttccagttgtcaacgaaattgaccaaccctcaagcagaatgcgagagaggcttctccagtggaagctggtccaactgacactcatcttcggcaacatggtacattccgttctctttcagatgcctccaaattgtttgtataaaatccgcccaggtctgaccaggcctggagcaactgaaattgtaacctgttggttcttatcttctgggatatcaaaggcaacattaaacacgttcaaccagaaagcaataccgtaaaccaacacagtggtctcagagtccaggtcgctgtggctactcagatatgcgtctcgacagacgaaggtacgttggacaataaatagactctctgtgataagcaatttcctggcaatgagttcaaactggcctgactcctagccgaaatctgccgaccacgtgggtattataggtatatactacttgcaacaaaaaaaaataaaaaacattctttcgtcataagaatgatgtcaaaaagcagatgtaaaaatccattgccttccaaatcctggctaaaatgaggtttatttgtttgcactggtgataattatacaactaagatgcaatcaccagtaagacttgaagaccatgatctcgcttccagtaatcaatccaccaacagaagccatagtatgctctgttacgcccatctattaatcatgggtcaccagtacgagcctgaagcataccggtatggtcatatcacaaattcacgtgtgaaatgctacatcctctagtgtaagaaggcgttgccatgctctgaagagtctttagattgccgtttaaggataactgattttcttttgcaacaagacgtttgtgcttgttttggctgttaatcgcgattttagatgtggaagcagacaatagtctaattagctagtagtggatatctggaccttgaaatatataaaatacaaacctacattgaatttctcgccagatcagtgagcaaccacatttcttcgctttagcacagcgcttctaagaataaagtgaccaattgataagtctctagataacgttgaatgccggcatttccctccttaaccaaaggtgatcatcataggcattccggagtaggtatctgtactggacggattagggttgattcgagaataccgattacgcaacaattgccgtgtcctgaatggcccgcagagctcaccgccttgctcgccatacaagacactcctttaatttgcaggcatttccctgctgtcaggtcgagtaattgcgtatgtctctgctaaaaatggcaccaaggctgaagtactttcgatgatggcagggataccagtcctccattccctgcaattgcaggcgatggagtgtttgtgcctgaggtgtcgaccccgccgttatcgccttccccgctgactcaagcagaatcaaaaattactcccccactctatctcctctcttccgtgcagcttccttttgtcgcgtccctagataccccctttttgcctttcaccatggccacggacgaggttaccaaatccaaaatcgcagagggaattcaggcccttaagaccgatgagtcggccgcttccaacgcccccggcgacatggccgccgccccgcccgtggacatggcgcaggatatcaacccgtggagcgtgagcggcgcaattgtcgatgggaagctcaaggcaatcgactacgaccgtctggtggacacgtttggcacccagctgatcacgaaggaactccttgagcgctttgagcgggtgaccggccacaagccgcacccgttcctgaggagaggcctcgtcttcagccaccgcgacctcgattggattctgactcggcacgagaagggcgagcctttcttcctgtacacgggccgagggcctagcagcgatagcatgcacctggggcatatggttcctttcacattcaccaagttcgtccccctttgcttgcggccaagggaatagaaagagactgacggagatcgcagatggctccaggatgtgtttgatgttcccctcgtgattatgatgaccgacgacgagaaaatcatcttcggcaagaagaattacacgatcgaggagatgcgaacgttcacccgcaacaatgcgaaggatattctggcagtgggatttgatcccaagaagacgttcctgttcagtgactttgatttcatgggcggggccttttacgagaatgtcgttaagatctctcgtctgattacgtacaacatcagcaaggctgtatttggcttcaatgagaggtactgtttccaggacaacctggtcgagctagatagattctgactctgttgtttgacagtgataacatcggcaaatcccacttcgtggctgtgcagtctgcgacggccttcgcgaccaccttccctcacatctttggaccagatcagaagaagaacgcaaagattccctctctaatcccgtgcgccatcgaccaggatccctacttccgggtttgccgtgacgtcgcaccgcgtctggggtatcctaagcccgctttgattcacgccaagtttttcccagcacttcagggtcccggctcgaagatgagctcgtccattgacacgagcgctatctttatgactgacactcccaagcaaatgtatgaataggctcctgtctgattcttcctagagatcaccactgacttggcttctcttgctctacagtgaaaagaagattaacaaatacgccttctccggcggtcgcgacacgatagaagagcaccgcaagtatggtggcaaccccgacgtggatgtccctttccagtacctcagcttcttctccgaggatgacgaggaactcgagcagatccgcacgggctacatgaaaggcgagattctcaccggagagctgaagaagaagtgcattgcgaaactgcaggagttcgttaaggcttaccaggagcgccgagcagcgatcactgacgaggtcctggatgagttcatgagggtccggccgctacaatggggccagggtcgggcggcggcagcagccccagtccagaaggagtctgagagcaagtagctgcaaatcatagagaaaaccagcctctctactaaccctcccacctatctatctatctatcacatctcgatttcctcttcctgtcatcatgctagcctagaaccaaacaaaacaaaacaaaagaaaatctcaaggactccagaatccatccacaatgtagacaccacacagcgtgtcggtgatgatgaaatgaacaagaggaaaaaaaagcaaacaagaagggctggaaagagggtggtggagtttaatgtgcttaatcttatgtttgtgatgtgatataatgacatggtatttttcctcagttaggggaagaaaaaaatttcctctctctcattctcgcccgcaagtcgtattttacatttacgtatttacgtattattcgacttcatggtgattggagatcgatcgatagatagatggatattttacacatcatttattgtttttgctagaaagaaattgatattaagctatacactaaaaagagaacaagagaggagaagactaggtaggtatcttaaaatatacatatgcagatggccccttagatagatggtaggaaaaggaacagaaaaaaaggggggaagggcgaagagggtaaagaggaatgaggacgaggatgaggatgaggatgaggacagattctgcaaaataccaacgctgagaacgctaatatgttgctgatatgctctcaacgagaacgggaagggaagagtggggtgaaggaggaaagtgagcaacatataacggtagcggaatgagtaagaaggaaattcgttaggtgcatttcatagctgtatcattaataaggcatcggttcaacctttccagaaccagcctccattagatttatcttgattgccgtctgacgccttgttgctatcagacgcccgttgcgtctgtttggcaggaggattgacaacttccacagactcgtcgctttcctcacggccatcggagaagcgcttggtcttgacaatcttcgtctgcaccgacccgtcaggcaatgtccttcgttctctcgttgtcaacgttgagatgatggaaggctctgagtccttgacgtctccagactgcggttttgtatccggaacatcactctcagagttacgagtgtcattcttgttccagctagattcgctctctctgaagtgcttctcccactgccgtctcctctcctcccattcttcgaggtgacgcttcctctcgtcgtacaacattcgcatgagaggactgtctgagaaggctcgggagtattcgcgttcatgcgtatcgaagatgtcttgaaggaatcggtcgtacagatcgagttctgtcgccgcgtctgctttctctgactccgcgtgtttcttatcgccggtattcgaagcagacgactcggctgtcgaggatttgtcattgtcgcgccgtgtagtcctctccaaaacgatgctggaaagagagctgtcttccggccccccgatcaacttccagccactgcccagactacctctctggataagcccccgcaaccactcattgcccgtctcctttctgctgtcagagtctggactccggtccagcatgggctggccattctcaattcgcaagagatcctcaaaagcatcccgccaccggggttcggatcgatctgtctcgccagtagactttaaagaagagaagagtgatgaaaagatgcctctgtgccggtccttctcgcgcgagcgctcaaggtgcagaggggagtaagggctaaacaagatataaggaatcggccacgcatgggtgccctctctgctgaagaagctgtccgaaaagaagggatggaacgagtggaaggggccaaagccgaaggggaaatggtcgtcaaagaaggagtcgaagccaaagaaaccgaacggtcgtcgagtatagaagcgccaccggtcaaagtcatcccagtctgaccacctgcgtccaccccaccatgggtcgtaaactgtattgttgccgttggaatcggttgatcgaccgtccctctcggagttcgcgttcgaatcggcgtcatctccgtttctcctctgtctataatggttgtgctcgtcggcaaagcccagccatctatccggaaaaggcggagccacgatagaaggcagacccatcactgactgaagcatagatgagatctgctcgtcggcgtagcgacgaaaggcaataaatgggttctcctcatcaagccatgaccgcggcgacgtttcgggacgcgcggaggggctgttggccccggttttctgctcgctggaacggtcgtcaccagaagagttccccatcgtagctgtggaagctgtatacgatgaatgacgacaaatatccgccgttttagacgtctccaagcgtcgttggagtcgacatgtgaagctggttggcgaactccttaagtcgagactccaagctcgaaggcggcaaccagcggcaagccatcccctcggctatcaccacgtgacatcgtgtcaaacagagcaaactttccttttcagtcgtctggcgattctcgtttcttctaccaagccctgcagcatgcctgataacgaagtcgcaatttgttgatctcgacttgaaagaccatagagtacataataatgtgtcattctataaaatgcatacataatgtgcaattttgcagtcatcacattggtctcacaattacatcatgtaattcactgcagcatcccatttgatcctgcttcacaatgaccagcattgagcatactcctaactatctgttatattattcaataattaataacctcacagatgaggccgatcttgaaactccgtccatgcttcatcaaatcctgtcgagcgaacccacattcgaccagggccggatactgagtcgataactgctccttgtcagcaccttaccggccagcctatggttgtgtggtgatgggaagggccttcgtcacatactcatgttcccaattttcagccacatgtctccttggatcacgaatcccttctccttcccttggccctcgaacggcctgcagaccctttctccgttcgcaacggctcgtaccattttcaccacatgtccgtcatcttggggatgcacgacgctgctatggaatatctcattccaatctcttgtgatcgggtaattcgtgacctcgtccaggagcagcttgggtacgccgcgggagacgtacatggcgagatccatgcgacccttccattcaaggagacggatcttggtgcgcaaattgatccagggacgcgagaagaatgccgagtagaaaattgaggaagtgacacagtgcatgaggaaaaagtcaaacttgatttctttggggggatgttgggccgttgtggtgtagtaaactgtatcacagcacgagtcaaattcatgttttccatgcaggccctaggggttgatgtcactaaccaacagtattgatcatctccgctagcttttcctccagctggtccgcagaaacggtgtattgacttgcatatttgaccatctcattaggggctctcttcataacaccgtctctgatcttattgccatcggaccagtgcacagattgtgcaattgtgctgtcctggcggagttcgtcgaggagctgcacaagcgtcttcgttcctcgtgatccgattcctgcggaagacctttctgctggcagcagataatctccgatccaacggtcgtgcgtagcagtctgggcaagagcctccgccacaatcgccggctgattgaactcgatgccaaatccgaggtgtatcagcggatggagaaagcctgatcaggcaggtctctgttaacgacacgacaagccgaataaaatatcagcagcgtacctgcaaacagcctgaccagcatatcctcggcatggtcgtctccagcaaacagatgctcattcaccacagcttccacccctttttcatcaatttcccgttggaaaaacaccagaaaatttgggtagtgttcctcctttcctagataatcttggaactggtgtttctcgattattgtgttgacaacaccctcgtcgacggggaagactggtctctggtaactgctgccacgctcgtaggcagtcctgatagcctctggtgacgctccaagggcatagagggacagtacatggtgtactatgtgatctagtaattgttaaattattcgatgaaggatccaaagatattctagaaatgaagagcccggcttactatggaatctttctacattgaagtagatatgatgcttttgcagatcctcttgcaaaacctggctggcaacctcggcagagtctgccctcacgcctgtactgagaacacctgtgtccgtggtggacagcttgatcgtagtggccgtagccatgttggttgtttcaagttcctgcgcgtggtagtatttctcaacaccgggaagtgctcgtactgcaggtcttatcactctccaatctcgtaattgaggctggaccacgctgttcgccgagcggaaagaacggaacaagaactgcggggggatttgcttgctatttataatggagcgacactgcaggtgagttgtcgagttccttgagcctgggacgactgtattctcgccaacaactgacttgggaccgagtctagactggctggacttaacaatgcggagagtgcgacgaaagctgtgcatgagctagtctcaatgtaggacacatctgttatttgtgcaaaccacggattagctatgtatactagtatgcacgcacgttgattagtgtcgatcacacctggatggacaaactcgaataggcggggaaacctgacatttgttaattaataataaggctgatctgaccagggtgggagagaatacgtacgatctaagtaattgagaaccaatggttgcccaagcatgcttcagtatagttaactagcaaagcgaacagagttaatggagttcgactccgcgtttccggtgtgacggtggctacgtcataccctgcagggcgtgagtaaatacggtcagcagacaccgtccattcattattcctgtaagaattatttggcaattaatgggaaggtcacaaggtgagctctcacaaccatgaaggtccagtataacgacatatgagcatcccaccgtcttcgatccctcgagagattttggtctcgagcacgccaagaatacatgtagaacatggatgtacacgcatacgtgagtaaagtgctgacagacagttctatataatgaataatcgatgaaatcaagagtgtactctacaagaggccatttgatcgacccaataacatttgaattaactctgcatgtccttgctccataaacggttgaccactttagtctcacaaaacaaagagactgtcctccatttttcagaggtgaacgttcatcctgcctcaagggtgctcacactagtacccagagggtgcagctagaccactgtcagagagttccctaaaccaattaagttggctggcctcacttgcataactagcgccagttagtgtttagatggcagcgaactgcatccaagtgagtgacaatggatttagcaataggcagagtctccggattggccgaggatacatcgttagccctagcaaaatgtactctctgtcgcacaaagaggctcatccattgtgggaccaagtcgatatggctaataccagcattggcgttggtttcgaactcatgagcatctttatgctcacatattcgcctcccagtgagaatcagcacagcagtgtttgacattgatgaattttatcaggctgggattcggttgctgcatgaaagcaaacactaaatttcgatttctcggtgcccctgttagtaacaatgcattcccagaagacctgccttttgccgtggagatttctttcgctgtttctctcttgttgtcacttgctctgaactgcactggcgtctggcgcctgtatcacatttccctgaatgagacgaatagttgtgtagccacctttctgtcttccaagtctgatatagtgccgattaccaatggaaagccacctggcctgagaaagtgcggagcaaccaagttctggaaggggtttctaaaacggactcaggatttcccgtcatcgttcttttcgcgataggaaaattcaatgtagggaggagcatctggcactgtggtggattactgttcgagaaagagaatccccaaataaaaatatcgcggcatgccggtgttatataacgcaaccagcaggcgttgtaccagtcaaacacagtcctccccaattgactttgggtctcttcgaagacggttccacctggttgagttccgatgccagtggcaaacggtatcgcgtcatatgaataatcaatcgtcctataatttcccatcgatctgaaagcaacacatcccacacccaggtcatatgctgattggtaggacgtactgagcaaggattccttcgataagggcgagagaggggaagagaaagaaaaagaaagaaatagtaagaagggttgtgagggtttttgagcctgttcgattggtctgtcagtttgatggagttacatatggaaggacgatagtttaggatgatagtttagcagattcctttatcagccctgtatggctgcaagagtagcaatcgaacgagtctgtattccgtactgtaccattctttgttttcttcgtaaatcacgtcagttcttctcgacagggacggtcaccgagtggagccagagccacagatgataaaatgatcaacgcaacgcgtgtccacagccttactccaccggaggacgcctgctgcaaaagaggaaatgtctctccgaagcgatggatggattgggaaggatgagggtggtcggagcaactccgacgacagtaatccgcgccatttattaatcatcctggagcatgcggggcagcacaaggaggggcagcagcacgagtgacgcacgcactcgaggcccaaggggtccctcaatccaggtatatctcgctctgtctcccaaggcgtaaacgtgttctccttcctttcttttgtgatcacccaactcgccaaccaatcctccatccgactgcgccttacctgccagagcaccaagtcaccaccatgtctctcggaaagaagtacacgctcaacaccggcaaggagattccgtaagtccacaaaatatcccttctcctcaatggttgtccagctaatgcgtgtcgaattccagcttgcgcggttacggaacttggcaggctgcccccggcgaagtcgctgccggtgtcttcgaggccctcaaggcgggctaccgtcacctggtaagtgttgttcgaggagcctgatatccataatagccttctgaccatctggcgtgcaggaccttgccaaaatgtgagcagattgaccgtcgaattgatataatttgggttgaaggttgcgacttgctaaccttattgtcgaacacagttaccagaaccaacgcgaggtcgctgagggtctcaagaaggccttcaaggaaatccccggcctgaagagagaggacatcttcattgtgcgtagccaataatgggctccttttatttcacattatagatggctaactaggaatttttttccactacagacctccaagctctggaacaggtatgcctgcgacacacaccattgagtttcctcacgtcgattaaccattcgcagccagcaccgtccggatgtggttgaggctgctctggatgacaccctgaacgagcttggtctggactaccttgacgtatgtatccgtctgcatctctcttccatgaggtttgaaacaagtggctgacttgagttctctctacatagctctacttgatccactggccggtcgcattcaagacgggtgacgagttgttccctcttgtggagggaaagaaccttccagacggagatgttgaaattgatgacagcatttccctcgttgacacgtggaagggttcgtttctctgaactggcaaatttgaggactgaatgtgactgatcgtcttccttgcagccatgatcaatctccccaagagcaaggtgcgatcggtgggtgtgtcgaacttcaacatcgagcaggtgagtcgagccttgaacctcattgctatctgtgcttgagctgatcgttgggcctgatatctgtagctcgaggcgatcatcaaggcgaccggtgttgtccctgccgtcaaccagattgagcgtcaccctctccttcaaagcaatgagctgattgcctacgcgaaggagaagggaatccacattactgcctactcggtatgtgttctactgacgaatggcctagctggctggctgctaatatttcgtgtctcctatcctaggccttcggaaacaacatgctcggtgttcctctgcttgttaaccgcccagaaatcaaggaagttgccgaaaaggcttccaagcgcctcggtaccacggttactcccgctcaggtgatgtaggtcagctcctcgctctggtatcaacgctgtctaaccttgtttaaactgctagtctcgcctggtctgaggttggcggacacagtgtgatccccaagtcggtcactccctctcgtatcgtcgagaacttcaccgacatcgaattggcgcctgatgagattgaggccatcaacgctcttggaaaggagcgccggcgctacaacatcccttacattgcaagtgagtttccttccctattgccttttttatgtcctcaacagaacaaatctaaccctgtctctttctctctgtacagacaagcctcgctgggacatcgacgtcttcggcgagccggaagagaagcctgctacccacaaggttaaccttggcgcgtaaatatctcgttctagatgagcgcttcagtgatactaccccccttcctcctcctcctcatcgccccaattgcgggatcgactgctggaactggaactggacaggcgacgtaacgtctcgtctaatatcaattatattgtagcagaaacacttttgcttggcatgaaaatcagctcttccatgtcggggacatacataaatatttattagtcctggcacaaattaaaaaagagagaggggggatgggtagaatgtcactaaaattcaaattcagaaaggctagatggttgaagaagcctagatagacgccgatgatagaagaacagaaatacacatattgtaatgtctgtctatgaagatcctatatcgatcctatatcgctctatttcttttttttttcgcaaaaactggcaagcctccttccgtgtgatgatgatggtaactaacactgggaatttgtcattatatagtagtaatatggcttgctaagatttaggaatgtagattttcaaataatgcatagtacagtagaacagcaggtagaataaccaacccgaaacgcctttaaattaaaaattaaatccctgtccagacgcctgtatttgcaaaggcccatcatcattatcatcaccatcatctctattcatccccaaagtgagtgattaccataactaatctgtgtgaatggcaaagcctgaaggggaaaaaaaaatcaaatgcactggtttaccgaatcaggtaatggtaggcactgcatccctattatggacagccccacataataatcggagcgaagacgagaaataataactgtccgcttcatgtcgaatcttctgtccaatcttttcatgctctataatgacgcccccagggcgatgtcccgcaacagatggatgcatcatctttgcagtctcatttcttccatttccttcttccgtctcaaccgttctctctccaacttccggaacagcgggtggtggccgaccttgtctttcagctgcttgttgcggctcttgttgtactcgatgtacgccatgtcctcgcctccagcaagaccgctgagggtggctgcgctgcgcttcacagcccccttcttcgctttgccgcgctgcccgccagaacgttcactgaagagatcgtcggtcacgtgttccacttcagcagaggtctcgttctgcaacatgacctcctgcagaagctcccgacgctcagccggggtcgagtatgccaggccctccatgttttcaataccttggagatgggtgatgaccttgaaggcatagccctggtcaaccaggaaggcctgtcttttggaggaatagtacatctcatccgtatctttcgataccagcgagtagaagaaggcattgaaaccctcgtcatttcggcgcttcgcccgcaggatacgtcccaggcgctgcgcctcttgacgacgagaaccgtaatgcgacgagatctgaatgaggcacgtggcttccggcaggtcaagagatgtgtctcctatcttggacaggaagatcgtgttgacctgctcgttgtgctggaaattctccagaatgcgcatgcgctcattctgaggtgtgccaccgtaaatgtaagccttgcccagctttagcgcataccgctccagcgcgtacacattgtccgaaaagacaatgatcttgtcgcctctcttttcgtggtagtcgatcagaaattgacaagcctggaacttccttggattcatgatatacagtagagccgccttccttgacttctctctcatgtactcggagtaaaattcggtggtcatcggacaccaaacctccgcgcattgaaccttggcgatgtggccctgatcagccagctccatccagttggcttcatagagcttaggaccaatcaagaagttaagatctttgatcttgtcgtcctcacgcagaagtgtggccgtcagaccaagtttggcctgcgtcgcgatggcggatgtgacctttcggaacatcgaagcaggaacgacgtggacctcgtccaggatcatcagaccccattcccgagactgcagccactccatcatcttctctgcgtcgtaagatcgtgctcttgtttgtgagaccatcgagtacgtagagacaatgattcctgtggatctcttgaacttctctttgttgtccgacgtaaagattgcaatgtcaccggggtcaatattggaccaacgtaggaactcatttcgccactgcacgacagacatggagctggtgcagaggatgattgtgcccttcttgatggtgcaagcagctgtgatcccaaccagcgttttccctgcaccacacggcaagacgataattccactcttggcgcgaccattaccaaacatcttactcagactcttctcctggtagcttcgaatctgtgcatttggtttcaaatcgatatccaaggtaggatttatctcgtcatttcggaaatcatactcctcaagagcagggcaccccatggcctggcaccgagcctttacagattcaactgcagtattcgggatttcgaagctgtgaacctgagcctggtcatcatcatcatcctcatcccgaattgtagcaaggatgtcatcctgcttggtggcgctattcatggcattcgccccgttttgttcagccgactgctccgacgtctgtttcacgccagcggcatccttggtaccaggaataacaaggccagacattttcggagccgcttgctgggtgattccttccgagccctgtactatctgggagccaatcacttcgtcttgcaggagcatctgtagcattgccgggtccgtactctccacgaagaaacggttgtgtttcaggacgacctttatctttccatacgacttcgtgaagtctatgatgaatgatttgatcgtgtctggaaggggcgttttggacaaccggtcgaggaaatggataatatctcttggttcgagcccaacggaaaccgctgcatagagactgtttcccgtcaaccgatactcatggagatggacgggccgcgagagcggttcggcaatagtggtcagaaaatcctgagcttgcggggctagcggtgagaaactctctagggtgatagtacccttgatggggtcgatccagagcggacggttggcatggtcgggtttgagagggagagatgagaagtccttgtaaccgaagtgaggatcttctctcgagaccacattcttcttgttcttgctgaaggattcgagcgaaaatttctccacgacccctttcaggttgtcttccttgccgtcctcgaagtcagagtactcatcgctgcttcccacgctttgcggggtgcccgggactggggtgggacgttttgaggctctgctcgactggccactgtcgtttgccttgcgttttggcgccatggtgctcttaggatgttgctatctttgcaggttgagtggcgaacgagtgtgggatggtgtgaggtgctcggagacggacagacgcagctccgaaaggctgctaacgcctcaaaacgtaccgtcggatcccagcatacccaagagacaccgtacagccgccagcgcggatgagaggtgtatgatgggctgggtggagaaagagtaagtagacggaggaaatgaagagcactggagatgttgaagtattgcctggaccggcctggagccgcatgggtgatactccggaagcgccgatttgttccgggaagccggccttgccactccgccctcgcgaccgtgaaccctttctttctcccacataatctgatttcgaacacagctctttctcagcgcagacatttacgtgtgctacattgatctgcttgccacaatgaatacggtacagactcactggttaccatacggcgatcgaacaatgactgaccatgccttcgtacctgtagatacgatctacctggtatgcatgcaagcttgtcgacctgttgagaaatacggaattcgatgactgatgatcccaaacctgctacaggattgggtggggtgcactctgcataggtgagcattactgtgacatgatcgcgctgaaacgaaaagcggtttcaattgcacgagacctccccccaatcgaagaattgggattcagctgacaatgggtgctatccttgtagccggcggtggtgcctactacttagctaagaagtccatcaatgcggatcgggctgccagatatgaagccgagatgaagcgcaaggcccagttggccgccgaagaggcagaacatcgacgagcccacgctgcatcgggcgcgtcgacatcgccgtcaacgccctccgtaccgaaggaaactcagaaaccatctgattcaccatttctgcaacgcgccaacaacgctttcagcggcaatgtttcgagggatgatgtagcctctccaagtacggaggccggccaagatccggcacccacccgtcatgagcccgacacggacaaggagaagttgctggagaagtccaagtatgaagctgcagaaacgttccgaccgccacgaggaaaccgattcagttgagaagagtgatctgatgttggatggcaattccagaaacatggagcctgtaaacataaatacgggaagtcattctgtttacatgtatcatacaatggtgcctcggcatgtctatagggatttaccggatctacttgcgacaagaacgtcatcaatgtgagtttcctcaaaagtcatgctgtccattctaaaatagacgagctctcttgcgtggttagttctttgaatttctagtctctctaccgtgctggaaaaaaaaaaggaaatacaacaaatacctggatccgaaattgatatccatcaaatttcgatcccttcaatccaaaacactcaatgaaaagtcgccctttgcgggaaaagggaaaaccggaccattgtcagacccaaccttaaaccaatccgcagaactccagaagtcccagaaccaagaatgaccacaccggatgagtaatagggaaatgaaagtcccgaaatagattcatctggacagaaaagaagaaaaggggtatctccgaaataaggtatcctctcccgccgtccgaatgatcaatcctatattaattcctgccgatcttcatgcaataccaagccaaaaaaaatgccccgaaaagaaaattgcccccgaacgccttcccgatgctcctgtgtcttccctgtcaagaattcagatggaatattggaattgatatgctgtgattcctctcgctgtttcgaagagtctggatatcattgctgcgaaatggcgcgaaggatgggaaaaggaaatgatggaagcactcttgcggcagtcgggttcaacgagcgtggaagcagagtggtggatgcgacctggtacggcgggaatgcgagtcagtcgcggatctagatagatagatagtcccaaccggcggatcagcactcacttgttgtggttggggtaacccaggctcttctctcgtgagctctccagcgcgggaggaatgaagggtagcacgaccgcagaaactatacaagacatggccacgaagcgagaggtacggctgtcgggacgtggccggtgggcggagaaatgccgcacagaatggcgggcaagctgagcagcgatcgcggtggacatggtgtctttttcggtggaggtggttgtttatgatcggtctgcaaatagattcgatccagcagccaatttggttcttcctagcagtcgatcaaagagaaagaggtcaagaagaaataaggagtgctgcgactgctaagtagtcagcgaccagcccaggactgactgctttgtcccccaaccacgtcggccctccccctggacaaagtacgttttatgaacccgcgagtcacgcgaatgacgctgtggcaccatgcttggggcgatgctgcagcaagaggggccagtgggagggtttgcggggctgacagggcggaatcactgacctgacaaaggcgcggctttccagggctggctcggaaaagacggatgatcgtgcagcttatcgatctgccagcaacccaggagaagcaggaagcaaaggagggcaaggaatgactctggtcttaaataacccccaacattctacttttaaatcgtttctctggtgcctgcagggtcctctttttctacctaaccacgttaccacggcgtggggcgctctcctggctgtgtcagtggtgatctgccaatcagaacgcaggcattaataatgacagtcgattgtcgattgccggccaactctggcccacaagtcacgccatctggaaggcagaagacctcatggcccgagcggtaatgccgcctgtaggcgcgctgaagcgcaaaaaaattgccattatttctcgcatgttctgttcatattgcatcttagtctggtgggtttattattaactactaccaagttgttagatggggccagtacagattactgcgccacaagcagacatatcgccggctcgttgaaatctgaaccgtgtccaatcaattttgaaatcgctgataacttcaacgagtaaaaatgataccatccgcagggatgggatgactgactgcatcagctgcgctaaccctggtcgaacccactcttactgcctgaacatcgtgtcctccacaattgcgcgactaccttgtgagcaacatgattcgatagttgcatactggttcgcgataacccagttagaccgaatttttttttccttggatggacttgttttgtaccagaaatctgcctaaaaaacactgatgcgcgatctatcgtaatgccgcttacatctgaatcactgtaatgaaatatgttacccagtctaactgaaagtattggttgctgtgtgtggcctagggacggcaaagtttctgatatccaagtcgggaaattattagcttatataggtaggtataacatcccttactcgcattacaatgagagatgaccgtactggcccaacatagtcgacatacattgtactgggatttcttttccattgtaacatttgacttaatagtcttttttttttctccacctctatcccctagttcatagaacaaatttttgggtcaaaaaagaagacaaacagaaccggaaaagtaatgagaatccccgcacagtcgctacctagttagttaactcattcatgacgtgtctggaaagtgtcatgcgttgtcgggcgttgccccgagaaaatatccgagaaatgtccgaacttcaaccatgcgacgctggtatgctcacgcacatggacccagcataaatcttggttatttgcttctacctacatgcgcctaagccaaatacggtgtttaatttccatcagaatgaattaattgcgcaaagattgcattatgtgggtttcctgttctcatcatgagcacatacgtatgaggttattacgacggtgcatttctactatgatttatgattgtattggatcgtattatagtcacaattgattcttctataattactttttttttctgaaaaaaaaataaaaataaaaaaataaaaaagcgtaagatctcattgacaagcacaacagtgataggcaacaaaatcatgaactgtatagaatgccggcctgcgattggttcatttctggtcacgtgccgtcaggacggctgctaggatctccgcttcggagaaacattgagttagttgatcgagctcacaagtgctgcttcagcctccatcaaagatatccttttttctagcaaactgagcatggcggcgcatcagcttgccattgccaaggcatctttctctgcaggacttttgcgtcctgatccaacttctgttcctcgcgacagcatcgccacgttccattctttactagacaaggcgctatcgcgctgctctcgagccaacatccaggtctgaaccgtttatgtccttagtgcccctcggtcgagatgtgattactaaatctttcctctgcctcgatgaatagacctgtaaggcatggcttcttgagaatgtcgtctcttcatcaaacagggcgggcgtcttgggcaagtacctagtcgccctatcggaatccttcaaggcggcagatgaaaagcagagcgacaatgcaaggcccgctgtctcgccctctgaaccctctggaaagcgcaagagacttcatattctctatctgctaaacgatgtctttcatcataccaaataccattcggagggtggtgccaacacgtttgtgacttttagcagtgcactgcaaccccacatcgtggaactgctgggatatgcggcgtcctatgatctcaccaagcaccccaagcatcatcggcggctggaacagctcttggacgtgtgggcggagaatggatactacagtgaagaatacaccaacaagctccgtgaggcggtgaagaattcggcctctgtggacgcaatcaaggcagctgttggtattgaggatggtgcgggggaatcacagcagaagggcctacagagagatactccattcatcatgccacccacccacggggatccctccactccatattacgatcttccggcaggcaactttattccccacatcatccccgactcttctactccgatccgaccagaagccgtgaagccgctgcagtttgtagcggggcccgcagacgagaagcttgtcgctgctgtgaaaaagtttttgaaggaagcggatcgaatatatggctcgaatgatatcgagcacgatgagaatactgttgtcgatatcgatgagctcgggcagactgtcatcagagacgaaaagactggagaaattataggtggcgatacatactatgggtggtctcgccagttttgccaacagatgaagaaaaggcgggggaaggggtccaaccgcagtcggagtcgcagccgtagcagcgacaacggctttgacaggagacgacgctacagtgatacaccgagcagcaaagagggagggcgccgaggtcgacggtcccgcagccgttcatacactcgcgaacgtgaccgggggcgacgctattcaagctctcgttctcgcagtcgttcacgttcagggcgaagaagtcgttccccatcgggtcagaggtctcgatcacgctcttattccccacgtcctgcgtcgcctccacggtcattttcaccgcgtcatcagcctccccctcctcagagtgcgcctccccaattttcattcaaccaaagtcggcaatttcaaccgccaacaacgggaatgtctgcgcctcccccgccaccaccgccaaactacaacggcccgtggcctcctccacctccaccgcctatgcctggttttgctccgccgtttccggtgccgcctgggcagtatccacagccgcctgctccgggccagtatcctcagcctcctccatgggggggaccaggggggccaccagggggacctccatacccgccgggagggcgtggaagatggcagtgagcatgctggcttaatgtgtacgtattttgtattagtaatataaagtcattgatggttatgataggataatcgaacagcgtttgaattcaactggagttattattacaagcataatcccttagagttttcaacagaaggcatcaaatttgtcatccatcaataccacacatcactaccactctggatcatgaaccagtaaatacgtttttttttctttttctttcttgtatttccttccttttcacggcctcttatttcagtcatctcaaacttggacatgaagtcatttttatattcacggcggattacacccgatcgtcaacaatgaagggccggcctgatgaacaacgttagttaaagctgagtcgatcttgaacgtcgctggggatgggggaaaaaaaagccgataatattgtccaaggattctcatgtatggacaatacataccaaaggctcagcactacaacatagcaccgtgtcgagacagaacgaatccggccagctctctggcatgggtgtgcctgtggaaaaaatagtaggtcagacgagatgagggatacaaacatacactttacgacgcaacacgtacagctaatcccgattatggacttaacgtcaatgtcgcccagcaccgggagaagatctgacaacgaatccgtcacgctgtgcgtcagttcctggatggactcgcagcagtgtcgaggggcgttggctggacaggtctttttcggagggttgggatgtggagtgctcttagtgactgctactgctggcgttgaagagggcggcgaggatagtgatggcgagagtgacgatggcgttggcgatggtcttgatgatgatgacgacgacgtctgctccaaaggagagaatgagctcggcttcactatcgacgagagcgtggatggcagtgtttgagaagcgatcgcaatactaggagcagatgacggaggatgagatgacggcgcatgagatgacggaacaaccgacgaagatgaagagcaagcagcatgcgaaggcacaaaaggggaaataacgacaaactcctctagtacttctgatcccgttctccacgaccctgctggacggccatgatgtccatgtccatgttcatgcccgtgtccgtgttggagtctccacggggcagcagcgacacgagaagtcgatgatgatgatgctgcggcgaggaaggcgatgaagaggtaggatggtgagatatgcatttttctttaaaaagatgcctccgccttctacttcttttcaggtcttctagaagatgatacttcactgccttcctacctctagacagagtcccttttttctcttgtccgaagaggtggtgatatcgtatcgtacagcagaacagactgatagatgtgattgactgcggttgatagatcgacaatcgagtcttgcaaacgaaatagaatcctctcttgcgtacacactgaagaagcaaaagcaaagacaggagagagatacagacagagaaagaaagacagaaatcaatccaagtcaccaaccagctcctacagtctgctacctagcctctactactgaaacgacttgccatgtgcatcacatccatttgaggtactgtacatcgtcatgtacatgtacatgtatgtgcagtatatctcaaatcccgaagctgatatacatgcatttactgtaatttacatacatgtacctagctagtcctatcaacccttctgtcacctcgttgtcaattcccgtgagacagctgtggaatgttcgatgacaccgtccgctgtcaatcgggagatccagagcccggctcctgggtctgagggctggacctgagacccggggattgggtacatactaaggtacgtgtggagtatcttgtacatacctgtacggcccgcatgcatgcctgacatcggaattaaccttaataatgaatgtgaatccatcgaatcataataaatcaagagcatgtacacgacatgtacattccaagtttcggaacttcggcaagaacccaaatacacgttacctacctacttgcttagagccacgacataatttttaacggaaggttcttttgtagtttatttcttttcttttcttttcttcaatgacgtttagatttctggggttaattaaattaaatagctttcatacctaaattctctctaggcagccacttcgcactggaacaaaaagctggttatgttgagttcaacttccagagctgaaccaactatgtatcaagctctatatctataccattcgtagagagaagagctcttacagagatagtaaggagaatttgcctatgttacggtgttattcagccatcattgcgatggctggacttggtaactagtaattggacagcgacgtctactcctatggctggcgcctgcatgccagttatcaaggcaccggttaaacggaacctacaactgtctaagcctacaaacccagccagtatctggtcgtctcgaccttgaacggcgctcggagcgtctcctcccccgtccccgtgatgaggacctcatactcgccctgctcggatacccacgactgccgaatttcgtcccaaaagctggtggccagcttctttggcacgactatttcgatcgtctttttctcgcctggtttcaggaataccttcttgaaccctttcaactctcgcaccggccgattgacgcttgctgtcgcgggagggacaacccacagctgaacggtctctgctcctgcaacagagcctgtgttggtaaccgtcagcgatgctgtgatggtttcgctaccgtccaacgtaggcttttccggagacgagctcaaggtcagtccagagcgggaaaacgtggtgtaagatagtccgtgaccaaacgggaacaaaggtcgcacttgcgtcttctcgtagtaacgatatcccacatagatatcctcgccgtagagcacgcggcctcgttccgagcggaagttcaggtatgaagggttatcctgtagacgggcagggaagctcagcgacagtttcccggacggattcacgtctccgtacagaacgtccgcaatgccgttgccagcttcattgccgccataccatgcctggaccagaacattggccttgtcgatccagggcattgtgactggcgttccactctgaatcacgatcgccgccttcggattcgcctcgaggacccttgaaatcagttcgtcgctcccagggggcaagtccatgtggtcgcgatcatatccttctgtctcccattcactgttcagcccagcaaatacaacaacctgttccgtcttggacgccaattccaccgcatgcgcaatcgactcttcctggttgaggcggcgacacccgccaaatcgaaatccaccagctccaaacgacacagtccctcgtttttccaacttcgaggtcggtgcggtaccaaactgaaacaggattttgtacggcgtgccagctttgagctccttggagcccctttcttccaccgttccagtcccgaagaaagacgatccgctccgctgattcgtgctgttgtccacaacaagctcgccatcaatgaaaagttttccggtgcccgcaacggtgactccaaaatcatagatcccatcctcatccggagtaaacacaccctccatgtcggcataccaggtttcagacttcaactttgggttgacgtagtctgcaaggaatccaatcgagtagaccaactggagcgtgtcgactatttctctattcttctcaccagggggctcattgtatactcgaaattcgaacccttgctttccatcatgagtgttcaacaatggacccaacagaggaagagattggtgtgcatagacaccctgtgagaaagaaactgttgctttgctactggcagacactccttcgaaaggagtcacggcatagtaaggaggcagagaagccgaaccaccaccacagaaggcggccaccttggagtttggcccgatcactgcgatcggcttgttcttgtcaaatggcaggacgcccccgttattccgcaaaagaactatcgactctgcagcagcgcgccggaggagtttctggtcctctggccgattgagaactttctcttcagcaccttccggtatgccggacttatcggcaaaatttaccagattgaggatatttcgcactctctcatccaggacatggtcaggcacttttctcgaagacacggcatgggtgaggatgggtccacgccagcgggtgggtccaggcatctcgagatcaagaccagcgttgatagcatcagacgtactgtatgttccaaacctaacttgacatcagtctcagagataaattaagagacaaaagggatagtaccagtcgctcataatcaaacctctccatttccattccttgtgcaagatatcttcgatgatcgctcgattttcactgacatggagaccattgactttattgtaggcggtcataaaacaggctgtctggcaaatcctcagagcttgctgaaatggcatcaggtagatctctcgcagagcccttgccgtgacgatggcgttcaccgccatcctctcgtgctcctggtcgttgcagacaaagtgcttcaatgtagccccaacgcccttggattggacgcccttgcagtagtgcccggccaggacaccagacaacacgccatcctctgagaaggattcgaatcctctgcctccaagtggcgatctctggatgttgattgttggaccaagcaagacatggacgcctttcgctctggcctcatcaccgagaaggccacccaattcctctagcaggtctgcatcccaagtggcccctagggccgttgcacaaggtaagcaggctgcgggaacgccattgaagaatcgagttccacgcacgccattgggaccatccgagaagcggagagaggggatatttagacgatggaccggggtggtatgccagaagtcggctcctggccgcagatttggttaatcattttgttccagtagacccggttgtcttactattccttacctgccgtaagagctactttctcttctaggtcgagctcagagagagtcttttcgacatctaactggaccattttgcctcgttagttatacgcaacactaaagagagaaaggtaaacagaaaatatcgccccgacaggtatgtaggacgagacgaagtgcgagaagaggaaggttgcggtcagataaatacagacagatagcacttgcctcgtgacgatcagtcggtcaggtccaccagcgagggccatccatcacattcgcggtggagatgacatggaatcctgcaggctgacggtgaccattggatctatctctccactgcaagctagcgggtgcttgcacgcctgagaatgaagatctgtaccgcgcacgcctacctaccaggaaaatgtgcactatattaacgttccgattccccgctggcggggaggtgaacaaccccacgagctcattagcctaccgattgccaatggaactatacgctgcagttatcaatcagcgttagtcgccaggaaagtttcacaattttcatactgaccaggccgtgaaaccggaagtgatcccggaaggttaatcctgtcaattcgagcggtggacaagcacaaaatcttggaatttctcgagcaatctggtggattgtgccgcagcggagtgaattgcttcggacgttctccgatttgggtaacttgggagggctgccagatgatgttatttataagatccgaagtttagccgggagggatcccgtgaatcctgttgtatcgttgttccgcagttattccgcgacatccatgattaatgattggtgtgttgatttcggagtatttaatgtcaagatttactccgtatttagttaacagttgtcggacccgcaaggcgttttccccacagccaattccgaggagagcatcgcggagtgtcggacatagatgacactagccaatcaatcagttcatatggtcagaatttaattatcagctgtaagctgctctggatgaagcatatttggacgagagtatcagttatcaaggcgtgatgtatatgacactctatctacatatatcaatcacgttggtcaaacgcaataagcttgattaattaatttatttagaagacgatatcacagaactaacttgagtgtttcagagaaaaagaaatcattagaacacccttgatatagacgggaaagagagaaaacggacagagatatcataacgcataacgtcgtaaacatagttcgctggtaacaatcatttgaaacggggaaatcgaacaagtatagacgtattagatgaaataagaaaaaaaagatctgactgagtccatgagcagatggatgtttgtctggtagcacaatcctgatctggtagacttggtgttggccctgggtcacgattgtttgctaggtgctgacaggcaatacctacctgggttcgagagcatccgacagcaacttgatcaaacagattacaacattacaccctttcaacgtctcccgaaatcctgtcaccaggagtagatctcggaggagaagactcagttccaccacgggccactccagcaaccgtcgatgcgttacttcggccactgctaccactggtgccgctgttgcgtctcttagcgaagtcgcaattgtcggtgaaggcagccatctggcgcagagtgtgctgaagcatgacctggttgtagttctgcaaggaagcacgaggatcccggccgacgccagaaccatcaagacctcgcattgtcgaggttcgaccacccggggtgcctgccgatggataggtatcttctgatgaattcatagtggttggcactttacgtctcattgatagacacctgtgacattgtcaggacgatttgttgatattgatagcccagagggtgtatttattctaagttactgacttttgtattgatacaacaacagccagtagggttgaaagacaaagtctaatagagaaaatggaggaacgtcccacaagcctagcgaagacaattcagacgataattgaggctattctgaatccgacagggatatcaaactcgcaaacacagtaggacttttgataatgaaggtcagagctgcgtttcgacgaaaacaaaaaccgaagtgcgcgatcaaagcaagagacgacagcgagtaagaaaatatgattcacgagaggacaagcaaacgcttttcttttcgaggatgacgcttcgttttaaaaaatccagtccttcaaaaccatgtccaaatacctgacacatttcaggtaggtagcagcctacagcccggacttggtaaaagcgccggcgacttctcatttgctcgaggccctccttgcccgagacaccagcagcctgtccgcgcttcatgatatcacagtttcccagtccgcgaaggctggggtagctgatgatcgtcatcgtgtgggttggtttgccactcctgactgtctgcaatgtggacccgatgcttgccagggtttgccccagattaggttacccagctaggtcatacgtacaaccagcctatggaccttgcacatcaatttgtatagtcaagcactgaaatgggcgggtgacagctgggatgaggtcatttcaggcatgggagtgggccgcgggaggccagatggctttggatcggcaatcggccggcctggacccctttgttcacagctaaggtaggtagtcagcgcagaagcttccgttagaacaaagagaatccattgggtttgtaaaaccttgctgatagcttgcactgagtcatgcgctgtctacagagtagtcatgtctgatgacatcttgtttgtactgtacagacaaagataactccacaaacatgcaaatatctttaattagaacagtaactgcctcttctgagacaatgacatggcattggagacatatatctagttcaagttaggatggttacgtgttatctcgacctttggccctagacaggttctagacaggatcgacttcgaaactgagcgagatggatgccaactggtcgcatggcattgatcaatggaaaaagccctccatgtcataaaaacactcatttgcagagaaatgcggtatctcccagctgcttacctccctacctaacctcgaagctctcatgctgtctgacttaatcctgcagtctactctgtcgttgtggcttaccatgggtcccatgacgtcacgctgcagatgtgggctttgggcttgaaattgatttggacgctaatcccttcctggacatagtcgcttgcaggaacagaatcttacataatcaattatttaagttagtaatcatgtgattttgagcctcttacaatactaacctatataggaaatatcacatgacccagaagcctcgtgttggttttcatggattttccgacttgagtcaggagattttggcgaaaatgcgaagtagttcacatgaagtgacatcaactaacagaccaactatgcaggtacagcaaacttcctgtgcattctctccgaatcccaaaactggaaaatctcatgctggacagaatgcagattaatttagctgtggaatcaggtgactcagaccattttatattttgctgatgatttctttctttgactgtgcattctctccaaaagccaaagccggaaaatcttatatcggacagaatgctcaatggatggcataggcttaattcagctcagtactcaggtcaggtaacctcagaacggctacctaaactactctgcattttgtccgaggtaattctctttgcgtttatatgcagctaatgcaactaatcctataactgttagtgactaatggcagtctatgagcagaaaagtagaaggtggatatcttttctgcgcatatgcagcactgacttgtcaaccggttggagacaactgacgtccctggtgttggcctcacaggctctcatcaaaagatacaatatcgcctcctaagcttcaactctgccactcgatacgttcgacgagaggtaattgaatcggggagggataaataaaggttgtaaactatgcatctccatgtttctcattcccgttgttacattccaaatcaggactccatgcgctctgggaattgcattaaaaataacgatgcagagaaaaagatagaaattccaaaatcgtcaagccattgttgtcatttgtccttgccttaacaatctccaaagcaaactttgatgcgaattaatacacgctagcctgaatatcaaatcgtattgcagtgtctcatcatcatcatacgtaacctagactgagttagtctgacatgcacatgaccatgcagattggcaggttttatgggcgaagaaacgagcagaatgcagcacagacacaccttttctagcaccctggaagaagaagcgcacaatgaagacttgaagcccagccatcgataccatcatcagactttctatgatgctgaagttgaagatacgtcgttcggtactgcgcacagtgctgaaattccggttctcgcgagtgcggaagtatttctggttccgggagatggtggacagttggcccgaaatcttcataatggactcctccaacgcagatgcttgctcggggctcgctccttgtttggaaggaagttgggcccgttgttcattctcgacctgcacaaaaagtcaattagtctaaatccttcgaatagcagccatgccattgtctaagtgcgtagaaaattcgcttgtaattatagacgccaataagaaagcgaatcgattgccaggaaatgaaagaggtgaaccgtaccgctatctcaaaatccaccattttctccgcaaacgtcgacatctcgttgttgaagcaaaaccggtactcgccaacactctgagctgtgaacacgaagtcaccctgtcgctccttggtaccctccataatgactttctcgcccgggccgacaacagagtaatccacatcgaaggaaccaccggattgaacctgatgcgccgacaacttgtcaattcaactattccccaggttgcttatggcttttaccgccccggaggacgggaattaaaaataataaaaaagagttcagagttgcttgcaatcattgcgaactcaccgcgaaatagaaagccaccttggaattcacttgttcgacctgggcgtagaagcatgccttctcgttggcttccaggttgtaggttaatgcagtcgcggtaaccaacggtatcgccgtggccaaaaggcccagcagcagactgtggaaacgcattttgatggacgaagagccggatgtgcagcaatcacgagggctctcctgggtgagtttgtttgcctttctccggttcaggagcgagctggcggtttatggacagcctagcagtatagtgtttgggttgtttgcattgattgatgccttaggcagaactacaccaactacaccacgtttcgccgtattaccctgtactgtacagtacattgtcaatgcaccaaggaacacaaaaacaacatttgatcaatataataattacacaagcccgaagtcatagtaaaccatgccgctcgctcattgctagaacatctgcacgcctacataacgcgacacagattcaacagggttatcttataccagtggatccgctaaaggccgccatggcaaatgagaaattcaaaaggaagcttaaaaatacctcactgccaaagctcatagtgacatggtttgctccaacatatcctgattgcactcataagaataactgagcccctgacaggataattttggtccaccttccacaaactccaacgaaatgaacgatcaagcaggggatcgattcctccaaccgcaaatcccaaacgcctgtgcggtgtctatttgatgaagaaagattcgcttctgctccagaggccccggttcttatttacatgatcgagaccaagaagatcgtcaggatcggtggctatatcggagagtatatcgtctgttactacgttagctacggacagcaaagacgtgtgacaatgtcgtcctttcaaggtacataccatcttcaaggtatcttgggttcgaatacatggcacgaggcaccacagcgaacttgattttctcgaactgtttgcctttgattcccgtccgcttcgagagccgctccttggtctctttgaagatctcgccctgccaactgtgagaatctactccgtgccatgatttctcaaagaacttacaggcttgaccacaaatttgaacggtatcccatgcggtttattcggttcccggtcaaagctgaaggcgttgatgactcgatcgccctcttgcatgttgagctcttcttccggaatcttttcagcatacagggtgacaaattcattgacaccagcgatgttgaaattgctgctcagctccttgtaaatcttcccactgtgtgcctcgtatatcctcacatcctgtatcgtatcatcgtcaagattcgctttcttttgcaaccccgctaacagatcggcaacggtcccggttctgggcaccaagacctcaaaaacttgctatttccggatcagctataactgctttctgatttcaagtgaaacagttccacatacctcctttgcgataccctcgggaagccaagtaaccttgagggttttcttcgtctcatattcgctaagactcgtttccaaaacctcatagtatagtgcatctgatctatgcatgctataaccataggttccgtattgaccgttgagtatctgatacaagttttggttggtggtcctcttgatgggttgctttggctttccggtgctcgcgatgacaggagagaaccgcagatgcgtcgggtccacgttgagatgctcgccaactttctttgaaaattggtcgtatgtcatcttccggctcagtgtcagcgtgaactcttcgccctcgctccctttaagcggagcaaacttcacattcatccgatttaagagatagtcatagtattgcctagtctccgtgtacagcgcggtcggtggtagcctgccaggagtcagagtctgtatcttatgccactaaacagcgtagagagttacttactcagactccttccacactcgttggaaagtgataatatctccgtcttggatttctgattgttgaaatgtttgctttggcttcattggatcgaccatcgtgtgtttgatttcctgtatttcaatgtcagaaggattttggcctacaaccagcgccgaacggtgagaagggcacttacctcgaagagcaagaattcagttcctgccggccagttcatcttctcgaggattgttggagccaattcagcaactctttggttcttccggacgtataccgggccaatgcctgtcaaggtctgggcgggaatatcaaaatacttcaaaaacacgaggacagaagtggctccatccggccatggaatcgtcccatctggtgcaaattggccaacttccagccacactctgaaagggttgccttttgtaccgtatcggttataagcctcctcgaccgtcatttctggatctttgataacttgatccggacgagtggtcttgttttgacgattaaccatcacccaaaaacggatctgcttgggatcgagacccctctcttccgctatctgctctgcgaattcccccaccttcttggctcggagaactcgatactgtttcgggagcgccggatccccaggcggaagatcaacgctcgttagatcgaagccatggtgggccttgaatgattcttcagttaagacaccaatgttgatgtacagatgggcttcttccctctctttctttcttcgagccagctcagcacgttcctcagcaagccgcttctctaaagccatagttagtaattaatgggaaaaaaaagcagttcccgatcgacgtaccgagatgcgcgggaacgtcatctttagttatcggaaccagaacctcatccaaccttgatttccgaatgtaaaccagcatgtatgcattcatcgaccgtttggtggataatcctcgcgcgtactgttgtcgcatggcaagcgagccatttgagaagtcatattccccaccataattctcttccaaaacctccttttctgtagcccggatgaccttgtcatcgtcgaaacggtagaaatgaccgtctttggtaggcttcaggaaggcataataatggccagcatttaaatcaccgctatggacgagtacaccatgaagctgatagatccaaggttcggatctgtctgcatcttcggaaaggtatggagaggcatcaaactccatcgggaaggcatgtcgatcattcaatttcatcattgcatcccggtggatgtcgtattcaaatcgcttcaagtggagatgcagtactggggggaagctttcgaaaataaccccctttttagcgtcctgaagcccgtatgggggaccggcatcatatttgttctcgccctcaagagtttccacttggatatagtccctgaaactatcatccagggtcttgttgcctctgacgttaagctggatatcccagaaatcttcaatccgcgaagactcataatcgacgttgatgcaggaaatatacgtttttgtctttccaacaaagaggtccgggagcgctttctcggccggagttcctttcatcttctcctccagtctctccatcagttttcgggacagctcctgaacatcctgctgttcgaagatttgcctggactcccaaccgaacgaggccgtgagctctgtcgtggaaacgggcgtatcactggtctgtagagaataaaagagtctttgcagtgtccaagcgctattgtctttcgtggcttcgtcctccgtcggaatttgatagacagcctgaaagcagttttagggtaacagaactcgataaaagcgcttccggaagcaagcatacctttcgaaaagcgtttgtaaagtacagcgactgcaatagcgaattgagataacaagtcgctccttggtttcttaaccctaccatcccggtttccttctttgaatcatagctgtaaccagtcagcaatgtgaaagctaatctagtgtcatcattttcccatacttctgaaaactatgccacaagacacctgtggggtccttgacaacacggacgtaggctgtgatattggcttcatcgttttgcacaagcgggacgcctcgtccttcccacggcatgctaaagagctttcgtaactcgcagaaacgagtaaaaccccagtcgccttcgtcggcattaaagcggtgtgttgcgactaatttgtcgttagcatgatctggcagagagggagaggaccgttcataccgtgtgatacatatatcgatggatcattcacgttccacaacaccagagcaaactggacgcaggcataccaattctccggtggttctttctcccacgcatgttcgaggtaaaaggaagcgtgttcaacgtggttgccataagggaaaaagagaatgcgcctaatgccatgtcagaaaatgcctggctttccagtgtctctcccaggaacagctttacgaaccatgggtacccagcacactcaaaaatcggtccatgttccttgcgtctcagcttccgccaatctgtgatgtgccacgtgtggtaggtctctgcctctgtctctaagtcgggatccttggggagaattcgtgccatcatcgcctcatctgttcatcaacaacgtattagaccctgttcatcaaatgaaatactcgactggtcggccacagcaggaatctgcgactccgagtcccccgaggtggccgcgacttctgcagcaaccagatggcgcaagacgggaaaacaagtgcttttcatcgatcaaactcgcagggaggaggggagtccgtacagtcatttgcgagaagctccggctccggctcttcttccgagccagagcgagacacgacgatgacatccgtacgatcgttgttgtattgctcatattcatcgacgagcatatcattgtccggaatctattggagatatatttacgtcagcaacaacccgttacatcattgcgaagatgttgcaggggcgttccaacggttgcaaagtccaggaacagtaggcagcaggcaggagggcaagggaactctcgagtcttacgttgtccatggaggaagatgcctccgcacaatgggccggaaacttcccacttcaatccgcagaggtctggtatggaaaaggtcgccaggagagaagacgagagaggatagaaacacgcgagcggtgcagggttggaatcgatgaagagatggttttctgaaggaaggagagtctgggctgcagattccagtacctctctgaggagactggagctagtggcggagtgtcgaaatccaataacagcgggcagagagcttcaccagccagccagacctagcgcaaccatacaccctgcttacgttggcccgtgagagaactgcctcggatcgatggcaaagtctcgcaggagccgattttggccaagacactgtccctttacgaaagcctggagtgactaaccagacccctttgccgaagacatccattgcctgcgatcgggtttcgagtggggtcgcccctccgcgtacggaagaattcccgccgctccagggcgtgatatcacagccagctctcgtgctctctctcaaagaatgctggaggcttgagaatgcagaagcctttagacagactacagcatataattcgttgccaaaatttttggaccccgtggatgaccaagggcgatatgcagagacagtcgtgctttgaacagagagctccatcgctctggcgttttgctgtggcgatactggcgcagtagtattattaacgttactaagtgtcattatatgcaaaccaaacacttttgacagtattctgagcccaaggcctacattgatgcgatgatatcttgttccctcgataaaacccacaacttccgcttccttagatgacgtagccagacgagttgtttgtcagcatgagacaaactacggtaacatatcgacaattgaccagactatccaaagtccgctattggatctacatgagatcaaaaattatcatgacttttatcagacttcttttccccttgtcctgcggttcatcatggaaagggttttatcgcgagtaactactgattagtaaatcgcagtcgttcaagagaggagctccatcgtggttcaacagcttacatctcaccacagtaaatttttctttttgattgttttcccagtatttctattctggaatgaagacgagctaatttgaagctgtattgtactgtgaagaaaaaaaagtctggctggcgttgccgcactaagcataaggatgatcttgaccgcctcccttccggggtcctgacgagtcataaagttctcttgctcacacgacctctcatgatcgcaaccaacagcaaagatcgcaacatggcacaagcaagacaacgccacgatccagtcagataaccgtctgaagagccatgccccacgactacggccgttttctcgcagtgaacgtatcccggttgtattatcaggaacgtgtctgcgccattcacgaattgcatggcagcacatcatgcagcggagtcatttctctcgatgcctacaacgcattaggctgagatgcacagtgggaactcgggagtactcaatccaatctcaccagccacctccgtggaggcctgccgccgttctagatgagtaggcgttccgacctcatactgatgggaagaatggatgctgaccctgcgacagatgggtggagcgtgaagttaggcccatcagtttgcgtcaattgactttctttggccgcacattgacggagtcgcgtctgattagctctgcaaattatgtccggacagagctccctacgaggtacgccccctctctcttacacgagcgacaatgccctgactccaccctgctcgacagaatcgcgcatcggcttcgggacatgcagaagttgccatacgttgtcgttgcaaacccccacatatcccacgtctatgagctctactacaaggccttcgagaggttcagggtcgttcccgagatcagaaccttggatgacaatgaccgatattgcgatattttgcgggagactctaaaagagcatctgacggtcattcctaatttagcaatgggcgttctggaatgccagggactggtcgagcctgacgagatggaccgtttcatgaacaccatgctccgcgcggtaagagacgtcccctgatggtgaagctgtttaccaggtcaaactgactgttccgtgaatagaggatctctcgtcgggttattgcagaacagcatctcgccctcaccgaaactttcaactcgccttggcatttcccggattctatggcgcgaacagacctcaatgcggatttcgttggagaagtgttcctgaaatgcaatgcgaaggacgtagtcgaacgatgtgggaagctcgcacaggacctcatgaaacagagttctgggtcaagtcagatcccagctatcaacgtacagggacatcttggtgccacattcccttacattctgagccacctagagtatatcattggggaactgttgcgcaattcgatacaagccgtgatggagaaatatcaggactcctccacgccacctccgccaatcgaagttctcatctgcgaagcaccccagcatgtgattatgcggatttccgatcagggtggaggtatcccacgcgagatcttgccatatttgtggtctttcagcaaaggaccacgtaccaaaagtcgcctggagaatctgggacaggtgcccaccatggctgctaccatgcaggaattaacagtcccagtggaccgaaagactgctgaccgagagacgtatcgcgagagttccctggcgtcattgagttcgcgacctccgaaccttcggcttggcatgggtttacctatgagcagggtgtatgcggagtactgggctggtagccttgaattgcacagcctcgaaggctacggtgtcgatgctttccttcagatatcaaaacttggcaacaagaatgaacaggtgactacaagggcagcgctggatgctgtatgagagcctattacagagcagttctggagatcgacgaaaacccttgtatttcgggtcatgggatccacatggatatgaatcctttcggctgctagcaccagcattccgtatggtgtccgggtgtgcagctggccttataccgatttttttttcccgacgaagaagtcttcagcggggacttcgatgctatggagatgggacgcgctgattttctcctgtatggaagatgcatgatatcctggttctcggtgtccacaagtagttgtgttggattgcggcattacgcgtctcgagctgagaacttggagcagcctataattggccgttcttcaacagaagctccgggcgctgcttagcgcatgagctgaagtagctcctggttgccttatgttgacggcggggaataggatcaggttatctaaaagaggaatatactgtaccaatttctatgcctcgtatgttatgctcctataaagacatgaccatgcgcaaaataaagtagttttctgattgtctccaagattgcaccaggtccgctctaaccgattctgttataacttcgcgttcaactaaaagcatagcactatatgcgcgatcgcctgtgtccaattctctccaccttccagcatccatactctgtaatgcacactacctgtgtacttttcctctagactgatgcgagattgagtcactttgccctatcacaacagggttgtacgtgacctatcgtcgtattcacttggagtacgcaggccttgccaccacgacgttcgaaaaatttagacggttctctttccgattcgttcaatagcctcttcagcttgtcgcagtggtctcagtctggtagggaaaaaaaaggaccatcaggtatggttgatctcgggtgctacgagttgccgagctgaagacagtatctctgcggccagcacatcggagatccacaagtcgatctgcagtcacgagggttgaacttggctgtcactatgggagcttgctcgagcatggaaccgggttttatcggtgatgcctccatccaatcggtagcaatccatgctaccatctgagctacatcggggaccgttggcgtgcgtgagaaagtctaagctggcagaatgcgacaagctatgcaaggagggatgaaagctgaagccaagatgccttctagcgcattccaactagagctacatggaagcttctgtatggcctatgtgccctctgatcttgcgatggcggccatggcatccctagtaacggagccagatcgctccgggagccgggactggcagacgccaaggacagacactgcgaactctggtctcccaaatttaagttaaacatcaatagtgctctgtgccttcgcgtgatcaaatcaccacgcagcgatcgttctcttgtgctcctcggtctcactaccgatcgcccgtgacagaagactcaatgtctagctcgaccaaagttaattgctaccacaatcaccactttgggcatctgaagatcaccacggtcccacacttcttgctaggtccaacttatcgtgaaagctagaactggggtgtgatatcgacctggctagtgaacaatccaatttcgaggctaaagaatgggcctgttgaatactgctactgggagcctctccagaggtgtcggcgcccagaatgagtttcagctgaggaccccctggccaaacagacactgctagtggctgaatagcctctatcttgtcgatccaatgctgacagttcgtgtccagatgactgaaagagatactgcagatcgtgcaatgtccctagtctattcacgccccacatggaagatctgcgatcgatcgctggtacatctatcaattgatcgatttagggcatttcagttcagcggaggggtccacctgaaagcaaggaacgcaaaaaactgcccgttcaggctattttcgagctcacgtagtttacgttgtagggaaatggtcagggttttgcaccacatacgggtcagcaacctcagcaggctggtctcagctctatctccgacatcactttcagtcccaggacacaacaacgcagactctggcaaatcagatagtcccggatactgtttctcggggcatggcaccttgtgcagagagtgttcgagcttgttcctgcgatgaactcattccttaacggcactcttggaattcatcagtccgcttcctccggctcttctgtatcatcgaagccctacgttctcgacctgtgaaccagtccatctccagccccattgactggtgaagttcgcatccaccgtcgcagaacaggagctcgagaattggtctaggccccagactgacttgtttgggggacttgctttgctcgaccgcgcggtgatcaactctgggcgatatacgtatcgaaaatggccgcacaccacctttgtggcgatgtcgttttccagggtgaagatccaccagatgaactgaatattcagccaagcagctctgcatcgcactttcacttcttgcttacccacctgatcttcgatgaaaggctctccacgaacatcctggatgcatttcaccatcctccagcggattggtctcatgtcgctttcaatgaggcgtccactcaaagttcgtgctgctgtttccagtcgagtctattcacaaaatcatggccaaagatcgtcacaaactacgagcttcctatgaaggacgtgccttccctctcgaccaggtgaggggaagttctttggaggtctcacatgcgccttagtgaatgtagcctaggactatgatacatatatccctcagatcttcccgatgttatcggactcttgagatgctgagcatcgtgcgctctgtgtgttctctactccaattcacctgtcttgtccaaatttgcctgtattctcctttcctacttgttaggttcaagtttcaatcatgaatccatattctgagaaggaccttttcctgtctgaaaacccggaagtggtttccttgaccgaccttgcaccggtggagcaagcgaaaaatgagccttctccgttggaaatattgccagaatccgggtcaaagctcgatgtgcagcacacgagccgtgagagtctttccgaatccttggatatccctgactcatcgacggattcttctggtcgagaagtcccaattgccattgttggactgagcacccgctttccaggaggtgctgatagtccagagaagctctgggatttgatctctcaggggagaagtgcgtggtcagagattccctcggagagattcaacctggatggtttttatcatccggtggccaatcgaaacggctctgtacggctcctttttatcctcgaaacggatgagaagactaataagatgcgctagacaaatgtccgtggcggccattttcttaaagaagatgtcgcggtcttcgatgccccgttcttcaacatcagtccaaacgaggccaaggtaacaatcttcaagtcaaggaatcggatatgcggcagaaattaaaagcgttaggctatggatccgcagcaaagattgcagttggaatcagcctatgaagcacttgaaaacggtcggttcattccaacaagacagtgtgcgagagatacttaccaagtcatatagctggcatccccttggaagaaatagtaggcaccaagacatctgtctacgtcggcaatttcaccagggattactgtgacataactgtacgtgatccggaaactgccccgttatactttgctacaggcaccggtcaatcaatgctgtcgaacagactgtcatacttcttcgacctcaagggtcccagtatcacagtcgatacagcatgttcttccagcctagtcgctttacatcttgcttgccagagcctgcgaagtggggaagcagatcaagcaattgtcggagggaccaatttgatcttcagcccccatatcatgaccactatgagctcgttagggtacgcaatgaatctctttccttctcacggctttttctaaaggaggatctagatttttgtcctttgatggaagatcatacacatctgaccatcgagcatgtggctatggtcgtggggagggattcgcaaccgtgattttgaaaccacttgatgctgctctgcgtgacaagaatccaattcgagcagtcatccgtgcaactgccataaactcagacggtcgtaccaaaggaatcaccctacctagtcgcgagagccaggtagaaatgatcagatctgcctacgccgacgccggactcgatcctcacgacactggatacttcgaagctcacggtacgggtacacaagccggtgacccgatagagatgagtgccatctatgaggtttttgcttcctcacgtgcaagggacgatcccctcatcgttgggtcaattaagaccaacatcggccatctcgagggggcgagtggtcttgcgggcttgatcaaggctgttctttgccttgagaagggcgtcattccgcctaacatcaacttcgagaaaccaaataaccagataccactcgaagaatggaatctgaaggtgagtctgactgtgcgttgtcttcgatagcgccgctgacgtgtcaacagattccaactacactggaaccatggccacctcgggctcttcgacgagcttctgtcaacagctttggatacggtggtaccaatgcacatgtcattctggatgaggcacgaggttatctgaatagtctttcccgcagggcctccgtgcagagctcagtcatactgccaacttcaacaaacgaaacaggaaagcattcagaattttatcgttcctttgtcttctcagcaaatgatgacgtttctagctcgaaattggtggagcgcatgcttgaatacctcaagctgaagcttcatcaggacgagcgtaccttcctgagagaccttgccttcaccttttcagaaaagagaacaagacttccattgaaacttgccgtatctgcttcctcgatctctgaactggtcggagaacttgaaaggagacctgctttccgcaaatctttccaggcgccgagactcggttttgtgttcaccggacaaggagcacaatgggcaagaatgggtgtggagttggaggggatctatgaagcattcgataagagtcttctcagttctgaagcaaccttggagtctctaggctgcccatggcgccttctaggtaagctatttttcacttgccttttggatgtaaagcgatcctctgaccccctatagatgaacttcatcgagacgcgcattctagcagaatcaacgaccccgaactaagccagccgatatgcacggcaattcagattgctcttgtggacttgcttcgttcctggggtgtcaagcctgccacagttgtaggccattccagtggtgaaatcgccgcggcctatgcagcaggcgctttgagcctcgaatcagccatgactgtggcatattacagaggattcttgtgctctcaaatggcgtctcaaggtacccgacatggcggcatgatagccgttggcctctctgctcccgagactcagtcattcatttctcagattgaagggggccggcttaatatagcctgttacaacagtcccaagagtgttacggtcgctggggatacgtgcgcgataaccgagttggagaagttattgctcgcaaagaaaatatttgtccgccgactgaaggtagacgttgcctaccattcacatcacatgcaggacgttgcgccaaaatattcggagttgttgcagaatctccaagtgcagaattcagatggcgttcaattcttctcttctgtgaccggtgcgctcatggaatgcagcagcctgaagagtgactactgggttcggaacatggtctcgcctgtattattctcctcggccttgaggaagatgtgttgggcctcggagacaggcacccaggacaaagagccggatgttgatttattgattgaaattggtccacatgcagctcttgctggcccaatcaagcaaattctcgacgacgcagactcaaaacaggacatcacatacatatcctgccttcagcgaaaacaaaatgcggtcaaaagcatgcacgaggtggcaaacactctctttatgaatggttctgctattgacttctactctgtcaatgattccggcgcggacgatgagcctcaagtcctggctaacttacccccttacccatggaaccattcgacaggctactggcatgaatcccgtatcagccgtggacatcggtttagacaatacgggaggcgtgacctgattggtgctccagaggacaatttcaacccgcgagagcctcgttggcgaggtttcctgcgattgtcagaattgccttggatcaaagaccatcaagtccaaggcaaagtcctttatcctgccgctggaatgctgtcaatggtcatagaagccatgcaacagatatcagaaagatcatctgaaacattcaagggactgaggttccgcgacatcaacattggtcaagctcttgtggttcccgattccagtgatggggtcgaaaccgtcttgagtctccatccttcgagtctcctatcatcgacagattcttcaaatccttggttcgagttccgcctgtactctgttgtctcagatgaatggatcgaacactgtcatggatacgtctctggcacgccgtcatcccaaatcggtgaattgggtaacgaagaagcccaccaaaagcaaagagcaatcgaggagcttttcacgacttgcagacagcgatgccagaaacacataaacgtcaagcatctgtacaaaaccctcgatcacgttggtctgtcctacgggccagcattccagaatttagccgtggtttctgcatctggcacgaataatatggccttgggaaccgtgtctattccagatacggcacaattcatgccacagaatttcgagtttccgcatattcttcatcctgccacgcttgattctgttttccatacgatcttcccagcgttttcgaaggatcaaagtgggctaccgcacccattcgtgccgacattcatcaagcaaatgaaggtctccaccactggcttgaacattccttcaaagaagctgaaagtagcgtgctcggtcctgcagaacgacttccggcagatcgactcgaggatgactgttgtggcagacgagtgcgctgactttgatccgttgatcgaagtagagggtctcagatgctctgccattgcgaacatggcatctgaagttaagtcaactgcagaagatcgaaagttatgcttcagagaggtttggagcgaggatatcacccttgccagccccgctgatataaagcatatctttcctccccctgaacacgatcaggctctgtcagaagtcgtggcaacttttgaggcagcgtcacttatctacattcgacgggctctcttggaccttggtgaaccagattttgagaagatgaagcctcattgtcgattcctataccagacactgagacaggtaagagaaaaagcggaaaggggagatctggggcatcaagcgctccactggctggcggcatcagagaaagaagaggaacgacatatctcgtctgcaaaaactcatggagcagaggggaaaatgctctgccgcatgggagagaacttgtcgcgtatcatgcgaaacgagacagaagcattgccggtaatgctagaaggggacctcctttacgagctttacagcactgggcttggaacagaaagatcctttggacaactttcaagcatcattggcaagctcgcacacaagaagcctgacatgaacatcctggagattggtgccggaaccggtggcgcaaccatgtccatcctccgcacacttggtggagcggagggcgaatatccgcgtttctcccatttcgatttcactgatatttcccagggcttcttcgaaaaggcccgcgagaagtttaggctgtgggcggctctgatggatttcaagaaactggatattgaggtcgatccgcagagccagggtttcgccgcgggcagctacgatctcatcatcgctgtgaatgtcctccatgcaacaagcgaaatgaagaaaacgttgaaaaacgtgagaatgttgctaaagcctggaggaagactcgttctgatggaaataacacatccattgctgcggaccatcatattatatggtggactcccagggtggtggtcgggtatgtaatggcctgccgacatcgtcgtgaagcaaaactgacggattcaatctaggtgtcaatgatggccgcacatctggaccaacgatcacagaagatgagtggcatgctttgctgagaaatacgtcattctctggactggacatctgtcttcgagatttccctaacgaagccgattacctttatagtgtcatggtttcaacagcagttgaggatacggagagccgctatccagatgctgttgtcattgatacctgtcagcaaagttacgtgtccgcggaatacctgcagagctgtctacagatttcgtgcggcattaaatccaaactctgcagtctggacacaccaacagagacgtatcatgacaaggtctgtattgttctagatgaactacagaggccaattctgcgcggaactgattctgcaaaatatgaatccatccgtcaggttatctcttcatctaagggcgtcatatgggtgacacgaggcgctaccctcgagtcatcgaagcctgagtccagcctgattcacgggctcatgcgttctgttcgctctgaggaccagagcaaaaggattgttacccttgacttcgattcggaaaatgtgctgccagccaagcaagcagccgagtcgattctccgcattttccagaactccttcaaggaaggtcagcagctcgagagtacagatttggagttcagcgaacgatccggccgcctcatgattcctcggattgttgaagaccgaatcagcaacgactatgtcgcgaaaggaccacaagattcgacaacagaaatgttgttcttcgaggagagtgagagacccctaaagctggaaataggaacccccggccttcttgacactctgaggttcattgaagattctgcgatggccaagaagctatctggcgatgaagtcgagataagggttgaggcttctggtatcaatttcagcgacgtgatggtggcaatggggcaacatatcgaaaacttcctgggttgtgaatgcagtggcgtcctcacaaaagtcggagcgaatgtgacacatttgaaagtaggagaccgtgtgtgcacactcgccttgggcacgttgaaaacacacgtccgctgcagggcggacttggtacaacgtatgcctgatgacatgacgttcgaggttgcagcatcgctaccggctgtgtattgcacggcatacctttcgattatcaataccgctcgtctgcagaagaatgaaactatccttatccatgctgcagctggtggagttggtcaagcggcgattatgcttgcgcagatgatcggagcggagattttcgtcacagttggtactgcggagaagaagcagtttatcatgcaaacttatggtattcctgaagaccacatattctccagcagagatgcctcttttgccgaaggtgtcatgaggatgacaaacggaaaaggcgttgacgtgattctcaattctcttgccggagagctcctccgcgagtcatggaactgcatcgcccagtttggcagatttatcgagattggaaagcgtgatttcctcggaaacagcaagctggagatggagccattcattcgcaatgtctcattctcttccgtggacctgacggggatcttccgtcacaaacaggagctgggtagctcactcctcgagaaagttatggggttggttcggagtggaactatcactcccgttactccgattacgacgtatccgatttccaaggttgaagaagcacttcggatgatgcaagctgggaaacaccgagggaaggtcgttatcacacgtcgttccaaggatcctgtcaaggtacgaatatatattgaccctagaatttctgttgttacgtccctaacagttaagaaaggtggtttctcaacgttcgaagagtcattcattcaaggaaaatgcttcttatattcttgtcggcggtcttggaggactgggacgatcgatctcgagctggatggtagataatggagccaagaacatcatatttctgtcgcgatctggcgctgcaaacccggaggctgctagtcacgtcgacgagctgagaagggaaggggttaatgtcgtcgtatatgaatgcgatgtgtcaattctttctcagctggccaaagtcatggaaagctgctcagagacattacctcctatccgaggcataatccatgctggtatggttcttcaggtaagtccgagataaaagccgctgacagcgccttgcgaaagtggatattaacagagttctaataggattccatttttgcatcaatgtcctatgaaaggttccaagctgccatccagcccaaagttacgggatctctcaacctacacatgctgtcaattgtcatgaattgggacctggacttcttcgtgatgctttcctcggcagccggcattgtggggaattccagtcagagcaactacacagctggttgcgttttccaggacgctcttgcgcgtcatcgcaacaccaatggcttgccagcagtatctctggaccttggcaggatattgtccgttggggccgtggccatgaaccagaactatgcgagcaacttggaacggtggggctttacaaatatctccgagaaggagtttcattcattgcttcaactcgcgatcttcgagtctcgtcagacagaaggaacttcccagatcattactggtctcgacacgcagcgtctcatagccagtcgtacgagcggcgatacgaaagacacgccgttgtggttccgtgatccaagattcagccatctcctgcagacaggtcaaaagaaggtcgcagaagccatcaaaacgaacgccgttgccagtctgcgcgaatccatccaggcgtctacgacatatcccgatgccatcaaggtgatcagcgaagccattacggccaagctggccaagatgctaacgctgccagcggagaacatcgatccctcccggtctccggcagcgtatggtgttgattccctagtagcagtggagctgcggaactggctctatcaggaagcaaaatacgacgttcccattttcgaaattctgtcccagtcctcgctgaccgcattggccaagcatgttgccctgaagtcggacatgttgagccccgaattgcgtgaggaagcagaaaaggatgctcaagaataattgttttgtatctagccagattcaagagcaaataggtacagaacaaagaacgtttggactttgtaaataaggacccatcttggaaggctgctagtacatagacagaagaatacgccacatcagatagtgcagcgccacaccatttctgcaatgatctgcagcagtgaggcggtgcggtccaatcagcgacgaggtaaccctggaatgacgtcatactcattgtatgtatcgagtatgtcatgatcacctccttcccttttcgaggacatgacctattgttgagcattactggccagtttccaattgtggcatgctttatgcatgttatcgaaggtgcaggcaccaaaagaaaacaccaaccgtccaacttcctacctactatatacatttctttctattgttacctcgcttcgaacgctccacatcctaccctgccctcactgtacaagacaccaagagatcaaccagtcattcaataaatcgaccgaccatggagagcgatctcagtgtgatcatgctcattattgtcactatcttcagtgagtacaatacacctgtgcaattgcgcacttttcttcgtccaactcttctcgaacgtatatacaactatgtgctatacgtgccgtacatactaattagtgcatcctacagttccccctctcggcgtattcctcctttccggcttcactaccgatctcctcatcaacatcattctcacgatcctggggtaagttttctcgccttctaccttattcttttgtcggttaggtgtctattcttatattccgctgctaaagaccttcctggctccccaggtacttcccgggccacatccacgccttctacctcgaatacgtctacttcgatcggcgaaagtctggcccacagggtaatctgggccgcaagcccgcgccgggcgtctactcgcagaagatccagagtggtggccatggctttcccgcacccgggtatgggacgatgcagtaaaaatctgaaagaaaacgagcagacagacagcaggctaacagaaggggtgcacctcgaaccgacgcccatgctggttagcgctgaactctctgcttgctgcctcgcgatgatcgtcttctacgaggccgtcactgtgtgggtggtgtataatgtgtggaggttcatggacaaaggggataccctccgttcgtgggaggctgaggaaatgatgatgaattgattgatgtgcgggaacatgaccagtgcgaaggaaattaactccctggcttggtttggagggattgggaggtggttgattcgacaattgagattttttttttcttgtacgagcgcttcgtggaagcttctgtcttagtattgctaatacattgttaatttgaccctaatgttctcttcttctaagcttgttttagctgctttctgtcatgcgtcgttcctaacttacataaatcctgtccaccatgactcaagtgaaatacttcctctataaaccacacgaccttatttatggggactggaaaccacgaaagttgtactttcagtttcttcctttttattaagaccaaccgaactcctggccatcgtcgatacaatcaaaccagactgcgactacaggaaaagaacaatacatatatgcaaattccatatcaattcttctcgctttacgtggctgtctcagacctgttactgcccttcaccgcgggaaagtcaaacggtttactccgaccagcctgtccggccgtccgcggaacggcccctgtcccgggactccaccacaaggcgcccacccagggctgcacgttccagccgacgatgagggtgacgttctcgcgctcggcgatcttgcccgagatgtcggtgatctggtactttgatttctggttgcggaggtgcaagatgcctggagtgtcggcttgctttttagacgatggtttctgttgcttctcgtcgttgttgctgttcttcttggatgtcccccagctggttttactgctagggaagaagcgctccttcagggctgggaaggagtagggagacttgggcgcagggatgatggtgtcccagatgatggcttccgagttacgggtgtcattaccggcacgagtggatggtgggtaggaggcgagcacgtagacgaagagctgtttcgtgttccagttgaacagaggggataaatctatacggaaatcgcggattagcggtgtttagtcacgctacttgattaaatatacgcaccggcgtcgagatcgaatcgaatctgcgcatattcctccctcttcgtcgagtagtagtgtggacggcccttgatactgttcgacatgttgcgtctgattagcacattgtcccgcaagctgcacaaagcatgaccaatcgcattgaaggaaatcatatcaattgacaaataaatcaataggaaccatcttaatgcaattcactgctcaatgggtgagggacatacacctgcacactcttcaactccacgctcgacgtgacatcatctgccggatatagcagcacagagagggcagccagaccagcgacgaaaagggccaccgtcgtaaagaagccaaagacggcttggatgcggttgagagacgaatacatggcaggcgaggacagaagagagcaggatcaggacacgcgctgcgacgggcgcgaggacgcagcagggtagggacgcagccggaagacgcagtcagtcaggtcggtgcgccctatatactgactgagctgctggatattggcaggaaaggaaggttgacgaagggaggacgaagcaatggttctagattgccgtgctggacgacggacgtcggagtgcggagttgaagccactgtggccgattgggtggactccaggactctgatcccgcggcagccccttatcgataagcaagcagacagaatacaccgagcgccctcaggaaaaaatgcaaaattaatagttggatagaaaataataattatactatagaatgaatattaattagattactatactaaggttggattataggctatttatatttctactgcagcgtggtcaatattcttgattagaacgaagaccgcataccttttcctgggatcggagatgtctagtatcattcagaacctcagcagtattttcatcacacatcttccagcatttgcaatagattactcgtttccgggaacactcccgcagtataaagtgcttctaccacgtgatcctctttgccaagataaggcttctggatgtagcaacctcatagaacactgaccccatggcaaacatcacatcctttacggaaggacaatgtgaccaagggggacgaaactgtcccggagcacttgcacagacatgtgcatcttcaccgtctatcgaggagccgacaaagtctgaaaatttcaggtcatcgtttgcgtcgagtagcaagttctgagagaagactttggactccattgtcgattgctgatgcaagcgacgtggtgaagtcaatagctggctgttgtcacagcacaatggtatgagtcgcagttgtagaccctttaccaatgtgaatttggaacaattgagcctacttaaatgttgactcacaagctatttatttatattggaagcggctagtgccaagtcatgtgatgtgactcccacaacattgagcagtaacgtctgtctatgaagtagctcagtgccgtgcaagttgtagtatgtgatgaaattctttttcccacagtgcaaaacctttgtctcatattggatacatgtattgggcggcagcctgtcagtcttgaattcatctggggatgtctccccactcttatcgataaggaggagcaaacgggccaaacacggcatctcacatacattacagagtagaaagacaaagaacatccatctataaagggcatctgaaacgagacagaacgtcatgtatgtcttgattactgtgtcctgatcttgtttattttgcgtgtttgcatctcggcgggcatatataaattctatctcgttcctcccttcacgaacatctctacttatttcattccatccacaacacgcaagttgacagttcacatctcaatttgccagatctttgtcattcccagatctttctcaaactgcaatcatcaacatgagtgatcatactctcttcttctacggtatagtatactttcttttgttggattctgaaaggacctgcgtccgctggcgtatctcatcttttggcatcaatctccggagttcttcatgactgactatataggaaccctgatggcgcctcagatcctccatcgcgtcatccatggtcgctcagaccctgagccttggcagaaggccctgttgaccatcaagcccgccattctccacggctaccgccgccatcgcgtgcggggtgctgactatcctggcatcatccccgtgacggccaagaccagcgacggcggcagtccgagccagggaaccaacgaacctactactactacttccgacactggtcattccgtcctggggaccctcgtctcgggcctgacggacggagacatctggcgactggacaacttcgaagggtcggactatgagaagcgcacggtgaaggtgcgcgtgctgcggagtgccgtggggaacgacgacgacgacgccgagaattcgcccagcaaggcggaacagagcatccacgacgtgctggacgcagcgcgtgcgcagctcgctgacgagggggaagaggtcgaggcgatgacgtatgtctggatcgggggagaagaagcgctcgaggaccgtgagtgggattttgagaccttcaagagggagaagatgcagtggtgggtggatgcggatatgagtgagctgtaggcgttacacggttgtttggacttgtcgactacattggtacaggaacgtggcatactagacagtaatagaatttgattagagaatgaatttctaatagaaagtacatcgatcttgtatgagtaaaaacagtcaccacttctccgctggacatcgttcaggcagacattaatgacaatagtagtgataataataagtactggagtgactagagggatgctacgctcctgtcatgagtctgactatcgaccaaaataaaaagcttaaaaaaaaaaacttgcatcaaacgcacagagtcatgtgtcatctacgtgtgattcacgtctcatctaagacacgtggacgccgcggcgatgtgtactgttgacaccacgaattgacttcagattggaccagggaggactgcaagcagtggcagtggttgtgtcaatgtttgacagagacatacacacaaagagtctgcatcggcacaggacggtgcatgaaagagtagctgctgatggacaaggagatggcccgcgcagagggagaacggtaagtcatggtatatagaggctatgaaatatatataaagcctcgaagacgtttctttggctcttctccgcaaaagttctttaaggaagggcgagcactgtggtcgaaaaaaatggatttacaagtaaatataaatacctcccgtgagcgcaattatttcaccatgcaaagatatatttattcagtcagtcagtctatgtatggtacgcgcatcccttcgaacccaacactggtatcatcatcaaactcaacaagtacagtacaaaataagtgctgtccgcattccgatgatgttttatgtgcagagatagagacagtactcagtgtcagttgatattaaaaatagcccacacaaacgccgaggattcccgaacacaacacatcctgtatggacctgccttgaaacctcaaaccgctatgaaaacaacatggaatcgcagagaatgtggcaaacaaaaaagggggaaaaaaaaggaacgaatgtaaagaaagatgctctgcgaaacagccagagcctgcaaaagcgctccataacgccccagctgctgtggcacaatgcagtcagttcctatctttcggttcgacactaaagctgaagttcatcggagtcatcctgctcccagaagcagtagtatctcgatcactcatcatttttatttctagacttgacctgcttaggactgctccgcgggctgtctagtaccgccccagacctgctgcttgaaggcggagtccccggaacctgaacttcaactttcactcgctttggcgaggctgtcaagtcaaacaattcatcaacccacttctcatcgggtgttttatgccgcgcttcgcgcgtcaccgatgacggcgaccttgaactttcttcctgtttggccttgaccacttctggcaagtcggtctcttcttccacagaactggtgctttcccggcgctcagaatgctgagcatcggtgtcacctgtacgagaccggcttgtctcatctggtctatgagattttgaacgcgtctcgtggacagattcagtgacgtcaacttcagctggcattgaagacttggtcttttcggagagctctctctccagctcttgctcgagttctctaaccgaatctttctcatgctgttcagctgacgcctgagcatggcccaggagaaaagagattggtttctcatcaactagcgtcttcccgccactgactttgttgcgctggatattctcctgctcctcttgcaacctgtagagaaaatcgcgaagccgacgtcgtagaagcccagatttcaaaggcggccagtctctctgtgcattcatctccctttgcagcgatttttccacaaagccatccggatcttgcgcaaatttctcgagatacgccagcaagtacaggccgcagtcggagaagttgggctgcaagggtatttcaccagcggtaatccccttgatgtccttgggatcgatttggagagatcgctttgacatggcttcctccaggagatatgcacgaagaactttaatggcaggataccgagatgcaccaagggaatcaaaggtgataatggccggttggttaacgtcatgtttagaacggcttttcctcttttcttttgtttcctgggcaaggccgtctttggatttttcagctgtctgctccgcttcgtcccggtcagctgaacgggatccgtctccggcgcgtgagaatctcggaggagaagaagtcgggttttcctctttctcgggccagtcgtcgtcagattcgggtgattgtccttcagagacttccacccgctgtgcaccatcagttggtgccgtatcagacaacgtcatagaagcaaaagattggcgagtggtctcttctggctctgctacttctgttgcattgccagattcatcgacaggaacgttttgaggagtctcagggatttcttttacctcactgggggattgggacggaacatctttgctgtcgggggcaggctccccaggttctgcgctctcttcctttttccgcaacaaacttgacaagttgcaaatgattgcaagataccagtgtgcactctcgttgatgggaacgatgacgtagtcacggctgaagaggtccacgtttctcgtccatttctgaacgccctcatagttgataccacgcttgcccctaggcgtatttgtcaaggtcgcaaagaagtaggaattgaaaaagtatgtcctttttgagacctccgggttgtttcgttccaagtgatcttcaagaaaccgaagatagaagccgattagattgtcgttcaggaactctccgtctcgaagacgttcaaagtcatgacggtccacttctgctttcttctttccctcgcgaggatatacaagaggtctatcgaatgtcaatatcgacgcggtatactcgattttactactcacctggaccactttggtagagagtcatttgacttcgactttggtgacgaagccccatcatcgctatcacacgttgtcagcaactataaaaaacacctagcacaataggatctaccaacctaatcaacgacaccagaccacgacgcgctttggagcgggtttcacgggtttcacggccttccgaagacggcgaagtaaacttcttgactgaaacgggggtaccggagtcatcttctttcgcagcagggtggctgtgagtatctgcggcaggcgagatagatgaagcctgatcccgactagatgaatctggcaaacggcgtggctgctgctttgcagcgccagcaggttgagtagtgacaacatcgtcgtcaccctgaagagaagctgagagctttggtcgtttaacgtgctcaactttgggctcagaaacggaatctggggaggcctctgggctgggacgtttgcaacggttgatttggcgaggttcggcctttcgcgagttttcaaatatcttgtccatccaaccacttgatagtataagcatgaaagtcgtgcctaatgaatggaaagaggttacttacctttcttttttccgtattttcacgcctttcgtttcgagaagattgcaaaggtcgagcttgtctttttccgactgaaactcgatatctaccgtctcatcaaaagccccttctgtcttagacaattttaatcggacctttcgactcccgtccatcccttgaagagccagagcgactttccgcacaggtatggtcgcacctttgtccacctcggtctcactgactgccgcaagtccaatagtttcattgctgctatcaaaaccgacatcgaacgcctgcttctcggaagcaactctctcaacagacccgaaacgaaacaaagaagcctcgaataaacggacgtgagactttccacttgtcacttttcggagtttgcgttgctttttcccttcgctctgacgtgagctagtaaatgtcgtcggcttaatatcactaggagatatccgctgtgtgccttttctagcatctttctcggagcggtcagaagatcgagactctgaagtgtgatctctcctgtaattaacggagagcgaactgggtgccggttggactgttgcctcgccctgcaactcgtctggactctccctcatgtcagaagtgcggcgtttgccgtccgtcgggacgaatagtttctgtagacgagggctctcttccccggaccttgctccaatcccatttggagaattgcggatttcaacactctcaaagacgggccgttttgttcgatgaccaagcctcgcggaagctgtctcgtcatcagatattgggctttggagatgccgatgcttcatattgtgagcggagggctcgcctcgaccatcatctgaaagcaattcctgcttcttttgtgggctctgtttgttattacttcctcgaagagcactggtcatcattttttctacccctcgatattcacacacatttttggactctggcggcttcctccccctcgctgaactttggctagaagccgaagacagccgatgctgtcgcgaggcttcaggtgatagggtgggcgaagaagttctacgcttcgcatcttcatcgtccacaaggttgataacatcccgacgttggcgtttaacgggcctctcggaatcgtcgaagtctgagagatcattcacttgaggactgcgaggagccggggagctttgatcatcaacttgcggttttgattttccttgagcgcgaacggggccgctttcacgagacttgcgggatagagtatccacgggcttgagctgagcaaacgactaccacacagtacatgtcagacaaatcccgcagcatagatccaaaatgacgcgtacctgcaatggcttcgctggcttactgaatgtcctccccggtatgatcgggacctcatcacgacttctcctatatagacagttggacatgagcgagatgaccgtcgacaatccagtgttgctccaaatatcacgtactcataattcggaaataatctgcgctcgtccgatggagcatccacgtttcgccgcctgttccacatcagatctcgaggtgccgtgctatacaggtgaaatcagaagggtatcttccggggatgttgatgccggctccacggtgcagcagatttacagacaacctctgggcgtggaggaactggggcaaattagcctgagctattgacatacagattggggctttggggcatggtcggtaacgagctggttgaaagtgtaccactgtcttttaagaattaaggctcggattgcaaagacagtgcgattaatgggagaggggtaaaaagagagccaaggactcacaaaatgccgaattccttgactcctgagcgaaaaaaaggtatccagaggtaattcaaggagaagactgctcttcctcacaccggacgtccgcgccggttgtcccagctcgaaaataccatgggctgcggaaggctggaggatatcggagtgggaatttgggtggtcgtggggagcagtccgacggtaaaacagcgggacaggttggcagagagctgcatctattcaccaagatgaccatctggatgtctcaataggcatcactgtacctgcatatacaatgatgttctccatcggagaaagaaaagtgacacagacacgatgatgaatgatgcgggctcctgcggcggcaaaaggcggtgcgtttctgccgtggacggcggtcagttggtggatggaccgttccgcaacgggcagcaatcttttacgcacagaacagtgcattattcacgactaagatacctactggggtaatcaaaaccaaaatttctataaaggggttactatcaatgtgaagctacaatatcagaattgaattatacagcccataaaccatccatgttcatcaaacctggcagccattgattgctgccaacatgcgtagcattcaaatatcaaaggagatataatctgaatcatcgactactctccagccaatcaagatttttttttccatttcccttttttttttccgtcgtagacgtcttgcatcaagtcaaagagagaaaagcaaaccaacatgcaagattcgcccgaagctcccagaaccagtgaaatgacgcgtaccgatagaaagttactatacagggccgtatcaacctcaaatgaccaccttttaattgctcacgacgccgccccttttcccttttctcctgtagaatcatcattggccgtcattcgacggcgatctgcaccatggtggtgatggtggtggtgatggccagcgtttccagctgccttctcctgacgcgcttggtcaatagccgatcgctgggcaatgctgtcgtcgtggctcttccacacaatgttcgtgtcggccgggaacgccaacagacgcttgatagtttccctgcggtggcttgttagcagcgaggcagtaaggtggactcaattcatgtctgataatacctaattttgatattccgcccaccgtcaattctcgtccaaacgctcaaaacgtcctcgccgctgcgcacactgagaactgcaccgcagatttcatctcccgcttcggcaaattgatcgccgacaattgcgagaaggagatcttcccagtagcgatcggcaacgcccttcttcagcctgacaatccatttgccgcccttcttgtttgcctcatcttcccagaccggacggatgcctttcttgaagatgtggtagtcggaaacggtaggaagaagagaaggtcgcttcagatgggagtagatagtccagaaattctccacggaggatatggacgcgagcgcaatcgtggacttctcgtaatcggaatacttgggagtcggtgggcgataccagagaacccacgtcgtcttcagaggatgttccttgggagcaggggcaggagcggcattcagggaggtggaagaggctttcgatttaacgttgtctgcggtcgacgactcttgctcgctggaggaatcgcgcttatctccggacccttttgacgaccctacgtcagatgtgttcccggagttcttcgaggtctttgaagccgacccaaaggaggcgaaggcacccgagcccaggccaaatgcgttcgaagcgctggaagaaggcgaggagacaccggcggagagaggagaaatggcgttgaaagggttggagcggccgtgggagctgtcgggcccaaagcgcttcgttgaatgactgcggggaagatcaagtttggcgccgccctccttgtcacttccagacgtagatagcgacagcttgcttgagctggctccgccattagagtcagtcgcgggtctccgtgcagggaatcgtggtgctttgcatagacgacacttacttggatctccgggtccacagattcgcgttatccatcgaggaagcggcaacgacagctcagaaacagtgagcggtcatcagacatgcaatgtgtgatacagagcgtgcaaaggaagtcggctgaaaaagagacaattgacggtcaccaagcgcaagcaaggggtcgggacaaagaagcactagactaaggcaccaagcggaagaaggcagcggcgaggaagacgtctttttgcaggatggatggactggaggctgagggcagaaacgtgatccgtcttggacgcttcctctaccctcaagctttgccggcgaccagccaatcgcgcgaccgtgccgccagcgcaagcccaccgccacaggctccaccgcctcgctcttttttcctgccggccgattcaggcacctctcttcccttcctctcacaacaaacccaaccaagaccaccaactcaaatcatcgccagaggctcccaatccctcccaagcgctggcgattccgatgtgtgtgtcgagattaattggatttgttccaaactccgcatctaaaaccatcatcacgagggctctcgtagctaccatgatgcggtgatgacctgagtgacgggacattttttttgatctcaaaatcttcgttcatcttcttgcaggattgcgtggtgttgtttgagaatgaatttcatctcatggtatgtcagctctccgtgtgtccacgcagtgttccaaatgaagagatccaagagctctggtaatccgagtcgctcaaccgcacctgactcttgcttttgcgagaccgctggttgagcctgacgtccaaaggcaaagtctgatcattgttttgtgtccaagcgttatcgttgatctctttaccatatgggcgatggctaacgttggcgactgagtagtgttgtaagaagtgcgcctgcttccctgttccttccatgcttcgaagacattcttgtagtgtcgcccagtctgttaggagattttaaaaatatacgggtgctttgctacactataacgatcgcaaagtagaggataattaaatgtgtggggtttcgttccaagataaggaaaccctcgatttttggtatttgtacagatgtgcacccaagggcaccctagactatctcgttattgtacattatcgagaggatttattcaaagctttgtaagaaattagctccacacgctagtcggtctcgaaggaatgcgcatacaccgtcccatcccggagttcgtgtatgctgtctctgtcagagggtgatccaacctctggatactttcgcccatctctcagttcatggatcgtgattcgccgatgataccttttccctcgccgtgagcgttgtacagaagacgaaccgcgtagtgaggaatcgatgctaccgacctcgctaggggcgacactagaggaagactcctccatgatgcctcgatcgatagacgactgcaacatgtaatccgcgaccatggcagccccatccttgcaataccaattctgcagatccgccacgtaggtgcgctcctcaggaccatactccactggcgggcctgtcacacgaggctcttcagcgtcaccgtggaataccgcccacgcgctgctatcagtgctgagaagcatcatggagtggttaaagctctgaaccttgaagttgcgaagcaggatcacgtcaccttccgagacggcaggaagtgcagtcttgttagttctgaaaatttgcgcaggaagcgtcgtaccagccatggacggatcagtgagccgcagcgtcagatagtaatctcgaggaccagaggtagcacgcgctacgggggagacttcaacagcgacggagatggtgtcggtcatagaattaaaccaatcaacaagagtagcaagcggagcaaaatacgacacccgactacgcaaccctgtggcacgacggtttggctgaggaaggcccttgagggcttcaggactcgccctttcagtgtccacactttcgcgggtagagtcttcatcgacctggacggcttcatcaacgttgtcttgcgcagcatcgacatcaccaatgttgccatcttctctgtttcctgcagggtgggtgtgaatgtcttcagcgcgctgctgtggtgacggcgagtagctaggaccgtctgtccaacggggtcgagatgggctagctgtagtgtgccgttcgagaggctcaatcttatcaggcgcatgttcggcgtgggatgacggaccggctagtggttcctgtgagcgaggatgcgtctcagcatcctgcgtcgcctgcggtgttggtatccatgtcccggaagcagtttggtgcgtcgatgtccgattaacttgatccaactgggtaggctccgggctgatgagttgctggcccgattctagatgggatacgctatgggtcttatcctttgaatcctcggtagcttgatatgtcgacattgcctcttcgtctgaaggggcctggtttgtatcatgaaacacatcctgagatgcctccggagggcgttgctcgtctctagtttgctcgggacccgaaagacgttcattaacaccaaaacttgattgcgtgccaagtagctcggggtgtatcgcggcctctaaggactccgtggccacagcctgtgcttgacttttcccatcctcattttcgggagggatataattgtcgccgtcttgagaaacatggtcgtctgtgactggcatgctttcctcgacaagctcgtcctcttcttcatctgaacggggctctgcgtcggaactagcatccacctccgaagttaccgtttcttcctgttgtccatagtcatcagacagttcctgttcggcctcgctttcagccacttcttcgtcctcagaatcggactcctccgtagaccgataatccgactcctgttgcatcgcacgcggtgaactaagtcggatatcttcgctaggttggttcggttggacgtcctgacgcgcttgtgcaggcggaggagccggctcctcatcgctgtcactatctatgacaataacttctgggtgcacagtcctctggggttgttgctgttgttgaggtctcacaacgtcgccctcgtcctcctggtcagattcagcctcggacacatcttcctccgactcgtactcgtcttcagacacgtcttcgtcatattgctcttcatgttcgtcatcttcgtcttcgtcatattcgctggcatcagtgacatcgtaagtctccctcggcacattccctaactgatcacttctatcgtcttcatcactttcttcgtcgagctccgcttgcttttcgacattgattgcgctggtctcagcgtcgttcgcctccgaagtctcatctgaaacgatggagattacttcattttcttggtgtttttcatccatcgcttcttcctgttcggcgtccgcctcgtcgcctacttcgtgttcgtcatcttcgagctcttctagctcctcttcttcctcttccccttcctcctcctcttcgtcctcgtcgtccgcctccctttgttcctccacctctacctcgtccctttcttcttggtcttcatccccggaaatactagtggtgtcaggctgaacaacttcaacgtcagttaattttgtctgatcctcattagaccgtacggttgtgaaattggtctcggaatctccctgagatgggacagtctgtgagactgatgaccggtcaacgttcatcgctgtaaagccagacacttgtgaaacgaattcgaattgagactcaggcggcacagcttgttggacatcgacagccatctcctctgctctattgtcactcatttcgacattctttgaatgatcatcttcgttaggtggatgctcctcaacctccggggcaacagccatctccgttgcctgcagatcattgctcgtatcctctggtacgagagcattcggatgatcttgttgtgcggaagaaggcccaagggaatgtccaacagcagaggtcgatgtcgatactatcggtgagggtgtagggaggcggtctccgcggtctgcagaatattccgaatgatcttctagggacgatatgacctgaatagggacagaaggaggatgttctggttggggggcatttggtgcggcctgctctaccggatgtggagatttggcatcgccgaccgactcagcgggaagattatcagagacatccgcttgaacattctcatcgatagagatgagggcgaccggttctttttccgcagtggcggcgccagttatcctttcatcttccgtcatgttaccctaggtgccggatcgtgacagttgctgcagctttcacttctgtcgaagtccatgacgcattacatgacagtctgtgtgtgctgatgtgttttttccccctaaaactgatgattcataaagttagtgcttgttcaatgacatccctatatgcctgaccacaatttttgacacgcaaccacgaatttcagaatatgacacttgcgcgtcttgaggagcagcgaatgtggggatctacggcatagccaatgtcaatctacacgcgcaaccacggttttccagaatcacctcttgcgcatatgcaagtcattggcctgtccaacgagactctgtaggcctggccacgtttttgggggaatcatgctagtgcatatggatgtctctggcttgtccgatgatattctatgtgcctgaccacgatttttgaaagagtcatttccgcatgtcaataaccatcagatgtgcaaatcagtggcctgtccaacaagattctatatgcgcgaccacaatttttgagaacactagtgcatacggaactctacggcatgtccagtgaaattttatatgcacgaccacaatttttgagagaagtccctggcgcatgtgcaacattggtgcatgtgagagtcagcagcatgtccggcagcaatctatacctgctaccacgattcttccaaaaaagctctcgcgcatgtgcgactcagtagcctgtccaacaagattacatacgcgtgaccactttaattgaaatatcgcactggtgcatatggagatctacggcttgtctgctgatattctatatgcccgaccatgattttcagaaagtacgccttgttccatgtcgaacgcctgagtcaacagcttatccattaaggggctgtacgcgcgaccacaaatctacagtgttcgctgaaatcgtggccacgactggaaagtgttatggagcacgccgcagaaactgggatgcctttttcaaaaaataacctcctctgcctttggtctttattttaaagaaaaatcccacagagtgtgtcattcatctttggttttcccctgacagcaaaggatcattgtatgtcatggcgaccatattacaaagtgacgatcttgacattgcccgggtatacaatagtggtaggagttgtcaaagtgcggcaattggaatgtttaacgttcgagcccaaaagtgtgtacggcaccagagcacctattcaaggaatgtggggatctacagcatagttgatgtcaatctacatgcgcgaccacagttttccagaattaactcttgcgcatgtgcaagtcagtggcctgtccaacaagattctgtaggcctgattacacatttggggaatcatgctggcacctatagaagtctctgtcttgtccgatgatattctatgtgcctgaccacaatttttcaaaggagtttatttgcgcatgttaatgactatcggacagatttgaaaatatcttattctgcccgtccgttatgtaccgctctactgaccgccttccagggtaaaagttctgtcaggccccaacaaaaatctggattatgcccagtgccggcacacctcttaactcaagtgagggcggcaaagtcgaggaaagacaatcccaaggcctcagcgatcctgaggccagcatggccatcgactgtgtcctgcgcccagaccggtcctaggaccacggacccaggacctgaagggccctctgtccactgtaccaggcagaaagagggaggtgtaaggatccatatgtagacgtcaatcagatgataacaaatagccgtgccccctgccgcgccaacacttcccgtgttggtgcgtcccaccacaacggacattttcaccacaacggacaatttttactattttctcaattttatgccttaccacaatgccaaaatcgccagacaaaattgaatccctaattgaggaagctttacgaaaggcttcatgtcaaaaaaaaccgaatatctctgcgttggcgcgagaattcgatgtgcctcgcggacggcttcgcgaacgcttcaagggtcggccaccaaaaaacagctcatatcgcgcgtaataaggcactagatgaccagcaagagaaggcaattattgctggatttgacagtttgattctctacactcgcagcctagccaaagatgattgagtgctgcgctctggccgaattggaaaacctcgtttatctgcctctagtaatcgctgaataagtgtttcctcttcaatagcctttaatctatggccattagcacgtgtttctgcgcgtggttgtcttcctttaaggcgagcgcgaagggtagcctcaggcaccccaaaaatctctgcagccttcagtattgatttgactttttgatttttataagctgcaatagccatttgaattcggttttcttgagataaaggcatttttgatagtggtggtgataaaatgacgcgttgaaaaaaggaagtggtagggtggaggaaaattcgtcgctcggtggtattcgtcgctcggtggttgattacgttaactaactatagtatggggagataggaatgtgtcagccaaaacgtgttacgtctcagacgaacaaccccgcactgagtatgaccaataaaaagaacaccgcttgaaagccacgatatgcctatcaggggtccatgatgtatataaagagagaagaattttacctagatagacagacgaggggacaagaaggacaatgggagatgagattacagaattggaaaacccattgagcctagagaatccttgacagaatgcctatataggaggcactgtaaaccctatatagggagccacatgttattgccttatatagtatgggaaatttcctatactttaaggaaatttccttagtgtataggaggtttccttatggttacaggagatttccttatagtctaggaaatatcggcaagataaattgtacgtagttcccccacaactctcagcatctgctacctgtagctttgtctttctcctctaacaatctaatctcctatgcctttaccactaggtaactaccacgcatactggtttctgtgactagtccactatttgtcctgcctcttgctcgttttagcgcttggggcatgactcggcaaaacaatgtcgccctcgccgttcgagaatctgcagatcaaatcgccagtgacaatcttacaataacggatgaaaggatcaaactccctggtttcgggccggacctcacccatttccccaggtctccccctggaccgtgatggaaaccgtctgcgatttcctcatgtcattgccgatgattggacctctggtggcgtgacagtgcgggaacgacggatgctgagctttatcaacgacatcacagacaaaccagggtgggagagggaagtctttgaccaggccattacggcacaatggagagcggaggcttgtgtctggagggaggacctgaatgatgtgtttttgtcgagcgccatgtttgattatgtgagtgctgtatgtgctcgagcgcaacacctctaacatggccagcagtgcatgcaagaactccgcgacaaaacagtctattaccagaaatcgggcatggtttccgtctgttgcgacaccgcagtggtcaaatccgatgttctcgtaccagcacgcctggccgaatcccttcaggacgctgttcgttcgctggagaatgttccagagtaacagaaaaattggcatccaggatcgggcaagaaagttctggatctccttgatccatcgctctttcctttgatctacggacagtcgagagtgttgccttctggaacggttccgctggaagactgctctcgctttaccggggagggagagttagttgatcctcctcttgaagacaactatcgcttttatcacgctgtatggttcaatgcctgggggagcttccaatggctgccatccaatgtttcctttgcggaaaatggatcaccccgactgactagctatatcaacaatctccacccgcaaatgcacagtgatctatacgaaattcttgaacaacttgtgaaatgttcaatgccactctggaatgagcgcttatcatggtttcagagacgacttcgaatccagcgagttgctggatcgatccataactttacactgccggaaggtgtgaagtattacccaccccgtgatagagtgtccgacacggaagacaaaagaagatggcctgtcattggagcaggtggaagaaaggggtttcttcttggacgaggactttaacagttggttctcccggcacctcgtcttgatacagagagaaccgaatgcctttatctctcgcgaacgatcggaatctcaacctgaccaccaccccttggatctgcaaaaagattttcgttcctccggtttgcagatcatcttcaaattggcaaatatccatcttacaccagaaaaccccagatacgcaggcgtcccctggcatatcgaaggagcgctcaatgaacatatttgcgcgacagctctgtacttctatgatgagcagaatattaccaacgccacattgccttccgccagtctataaatacggaagacattgagaatgaggcgataaaatcccttcgttgcgcaataaaacggactaacgacatgcaggatgagcacgattccttgggaatgtactacgggattggatactttaagccagccattcaagaacttggccatgtgcatactcgacccggccgtctgctcgtttttcccaatgacctgcaacaccaattccggccaatcagtctcgcggattagaccaagcctgcacactgcaagatccttgccatgttcctcgttgatccatacgttcctgttctgtcgactgccaatgtcccgcctcagcggagagattggtgggagatcgaagttcggaaggtcccttcatttgatattcttcccagggaaatcttcgacatgatcgtagggtttatcgatggtctccctctgagctgggacgaggcagtgagggtgaggcaggatctgatggatgaacggggggctttggtggacgagttaaataagaagatgaaaagggcatgtcgataagcaagacattgaatacttggatggcgtattgattccgctgcagaatagtcttgagtgtcgtcagcgcactagacaccgcaatggtcacatattcagtctgtagaggtagaacaggactgacaagaaaatatgttactacagcagccatgactgctggcgcagagcctcggtatgaaacttgggatgtcaatatgtatccaatgtccatgacacctgttgctagcaaacagagctgggttgatacaaagatggcacagaggacgaaagcagagctgtcactcgatcatacagaaggaatgcaggccctcatttgctgaaagaaacacttgaatatgccaatgcgagtctcgacgtatgaaggactttcaggagccgatattctacaattatcctgagctaggctagccttaccagtctttaaaatagaaacaatccggatatggatgagggcgataataataatgataattaaaaactactgagtactccgtaaataagttgaactacgccataaccaacagcccctaactgcagacagccaatgagtgatatcgtcgagtgccagtatcatatccgccagacaagcagcgtcattctcatgagtatccctgcgtgtttctcacctttcctaatatcccatattcaagctgcaaaagttttgcgttattgatcgatcagcatagaagggatttctgtgctcatgctgcgtgcattcattatggattcttatactcgatgactgattgtcaatattctgaacctgcggctgttttcttacacagggtgctgctgcggctaccctctccttgaattctacttgttttagctactgatttttgatgcttgtttggtcaaaattcagcctcgaataattaattatgttgctgcctgatgataatgatgccgacgagccgacgacatggatgacgaacgacggactttggtgttgcacggcagtatcgtactgttctggtctctgaagtttgtacgtactgtcggatctttcggtatccggatagaagatacgaatatccaccgttcgttcgaacacttgatgcctgcaagtatgtagatgcctgctaggtacgtagtaagtgccgaatacttggtagatgtatgccctggctgttgactgcgccacagtccgatccagtcgggaaccatggatccatacagagtacacccagcattacagatttagatttggctgtgccgtaattgtgtactcgtaaaagaaagagaaaagaaggaaaagaaacgaagcagaacgctgctcttgcggatacaatactgaacggagtaaaataaaagtacggaggaaaatcggaacgttcggatagctacatctacgtgcagcggaactaaggtgtttagtactccgtactatagttttatttactctgtacagtaattatcacttcagcaaacactcatcgatggatggaagttgagatgtcgttattgatcagatcattgacatcagaggggaaaaaagaaaatgacgactcggaaagtaaggatcttctctgtcatctgcaaagatccggtaagataatatgtttctgacctgagcggcacggcactattaaattaggtagtagaataattatattcgtttctaccttgtagggctgtatctatccacacacagtccacgcaccacaagaaaacacttagattatcgaatctgtcatcatctctcttcttctattattatcatcatcatccaagaacaaagtattcctccagcatggccacgatcaggcagcttcatttccagtatttcccccttgcggctgtacagggctgctggccaatcagcgaaggcggctgcccctgcgcctcattacgcatttccccggtcggtaagattaatcggtaagattaccgtctcgtctgccacttgtggttcggagtgcgagcgcttgctcaacagcgtaatgataattaaatccaagatcttggctccgctaggcagcttgtttgagcagggattgacgcggatcgaaacgcccgccccagaatgtcgtcgactcgttcgtgtattacaccggtctgctgctgtgcaaggccagatgcacagccgggcacgtatccaagggggctgagcgagctgagctgtcccacaggaaatcaatagaccgggatatggagctgatgaggtccgtgtaataaacatactactccggaggacaggctacgccgtataagaagcggctttctgcccttgctgctgtttctcatactctatcatctatacattctcgcaagtggcctgcctctgccagcatcgttcactcaatcaattcctccaatcaagtactccgtactactcctgatatcatcaacatgcagctcaagttcctcctcgcttccgccatcctcacctcctccgccctggcgatgccccagcccacccccgctcctgtccttcaagaccgcgacatcgtctcctgggccctgtccatcgccaccgaggccgccagcgagggcgccagcatcgccagcgacgcagctggggccggcctaaccattgccagcgacgccgttagcgccgcccagaccatcgccagcgaggccgagtccatcgccagcgaagtccgcacgggcgcgacgtcctatgcctcgcaatgggttacccacgcgctgagcgtcgccagcgaggcggaatcccgggccacgcagctcgccagcgaagcccgcaccgagaccgacagcgtcatcgcgtcacgcaagtcgaagtgggcatcgatcgaatcggcgattgcatcctctgccgagagcctagctacgtctgtggcctcgcaataccatgttgagatcgtcacgactgctaccaccactgccactggcacgagcactggcacgggcaccactgctaccggcgcccaggccactgcttcgacttcgtcgtcgaccggcggagccatgcctgctgccaccggtaatctgggcttgagcattgctggtgtggctgggctggttggtgctgttgctattgcgctgtagtgtgcacaccatagccgtgccaagttgaatatgatcagagcgaattcaattcctcatcttgcttcctccttcttgcgttgcaattttctacctcttcttcttcacttcagtcagctgtttgtttcctatttccggcgttagtgcggcatataaataaataaacgggtttggttggtcgggttcgtcatgtcaggagagatgaaaggacaagataagatacctatgattgtattcattcgtttgtttgttcatgcgtgtcatgcttgtcatgtcatgtcatgttgtgctctattattgtgtcaagtcatttcggacattatcgacgacatcatatcatatcatatcgattcgattgagatcgagttcgattgatgaaaatgatgatgaatatggagcagtgttgcaaagaataaaaaagagagcgagcaggtgagagagcagaattcaaaaatgttttccgggacaatcgcatattatatcctgtcgtatttcatatctgttataaatacgtacgacattcactgtaccatacatagtcgtgtgtgcaggtaaggacgagaatctgacgaatccatccacacagagtaatagatgcaatgaatctgtgaacaactatcaactgctgaataggtaagtagtacttggaagcaggaagtaggtaagtattgtttggcgtcaacaggttcgagtgaataatattctttcatttctgtttttgaggtcagtcagcttagatcagctcaggccggatcagattggcttggaagcgtttttttttcttattcgtccaaatgaatcactgatcactgagttacgtgtgagctacttgcactgtcgtgcctgtatttagcacgggaatatcgacttcaataagattattctggcaatatatatatacagtacattgccctgctgtctcgtatatacacactcttcgctactatattcctgccaggatctacacggtggtcgtcccctgctgacaccctatcgacccattctggtagttgtacttggtcgacgtatcgtagtcccaccagaacttcagatactgcgggtacgacgacggcacctggcacgtcttgacatagtccggcagactcttctgcaggatcgatgtgtagttggccagcgggcacgagtacccgggtcccgactggcacgcgttgaacggaacgacggcctcgttcagcacgatccgcacgtacgtcccagcttcggaaatggctgtcgcgttgcagctgagacgctcgatcgtcaggtggccttgcatcggcatgatgttgccgattgaccatgggttgccgaaggggatatagtctaggggcaggtcttcgtgcgggatgagaaggcctagcgcggcgatgatcggggtgatgttggtgtcgtgggcgctggattgagtcagcattaacactcgctgtggactcgctgtggtgcatagcagatcttacaagttgaagaacagcgttccagccgatggcccctcgttcagcagtgtaagactcgcgttcgcatacacggctccaacggcgtacatgttcctgtcacccggactgcacaagttagtcgatgaataatagtcagtccactcgactggctgcttaccctgcacagtagtaatagatcaggtcctgcgtgtagccaaagctcacccactcgtccagcgtgaacgcattgatccagtccgagaacggccgggcgttgagctcaaaagccgccatctctgttcatgtcagccaggtcttcgcaaatgacaggggtgctgcctacgcatcagattgtaaacatccgtcgcgttgagattaagtcccgggttctgcgtgtttaaccgctcagcggcgacgtaaaactgcggcatcatcttgggcagcgcattgcaggtgctttggtcattgtcatggtcgcacgtcggcgtcaggctgtcggcaccccggtcctcgtcctcagggatgatgttgatggccgcgctggtcgaatagttgtatccgaagaatccctcgccgaacttgcgcgccgtctcgatcacccgctcaaagccgctggtgaagatgggcacgaccgacttgccgtcccacagatggccgtagcggtcgcggtattcggctccatgacggaaggccgtcagcaagcccgcatacggccccgtccacgtctcagccgagtagtagcattcgttcgggacgaaataggtccagtcgttgaggaaggccaggtcacccttccagtcggtgatgccggaggcatagatcttggacagggtctgctcgaaggcggcgcctacgctcgggtctgggtagcgttcgccgtgtcgcatgatggtgatgacctggtcgaccgcacatccagacggcgggtctcgttcgatgccgtaggaggcgcgttccgagtaaggcccatttccgccatagtgcttcagaatgctgtaaccttcgctgaattgctgagagaactgtttctcgaggtaggagcgcgggttggcggcgccgtgcgtgcgagcagaagcgcccacggcggtgcaaagcaccagggcggcgtgatagaatccgaccatgctgggattcggctgcagctgaagatctgcgtcaaatcggatggagtgcagtcaacgaccagcattggggccgtcgttccatttatccttatcttcgatcatgggcttgtggggcatctgccgccgtcagtcgtgataacaagcaattagatgcaggacagctcggaaggaatgccagatccgcattaggatagatctgttgctgggcaagattaagcgggttgcacgcttgtttcaccccggacgcgtcgctagggacacgtgccaggaacagcatacgtttagatccatctgcaccagctgctccacggccatcgtgctggcagagctgctgctcattggagtcagtggccatgcgatccgaacatccgagtgagataataaccagccaggtacagcttctagatgggtccgccccaaagccaaatttgccaagatcaccgctgctgattgataacggagagctccgcgtttttgatgttaactaattggcaccatcgtggggcttagcggaacggtgtccgttaggctcaggccggtccctttctgatatcaccctgatcacatttgcgtggtttttctggaggacggattgttagttactccttagtattaagtagtggttcgaaacgtggtattgctgggtatcctcgacttacgcccgatcaggaaggagaatccacgtgccggcagttctgtcaaaatcgctatctccatccgcgattgagcctacaggtcgttttcaggatgaaagatggcaatacggggagctacaaatcgagcagaaatgctgtcttgatgtgcaatgtgatctgtctcacttgaggccactaacagacattcaatcagtgagccggacgggagagttatcagaggacagctcactgcctaggcttccgggtgtaacgtatgaattgaatgggaaaggacggcgtgtgcagccatttcgtctcgtggcagcatgatattatccacagaataattcattgaaggtaaccaagccatcgatgcatccgctcgatggaatgcgcgtggattctgcgcgttcgctatcgaatgaattctttcctggctgcgcgatcaagcgcagcttcacgaccattctaagaagacaccagcgataggtcagagtttatctctcagcagagaaagggaaacttacgaagtagctgtcaggtcatagaacttgaggaacgcggctattagcgactgatgatagagaggtgtgagttgttccatgactcgtgactcgctaaatggaacacgtgcctgccttccgtccctctaacgtgatcagccagccgataaggaggaaagcatctctcatcttcgcttgagtaagagtcctcaatcttgaaaactcgcgttaaaaccatagctctatcatgggcgacatgagtacggcgtttgttgctaaacagagtggttttgctcatagtatgaggttgtggtgaccgtccttactaccagtatactgctgctgatatagtgaaaacctgaacaggaccagatacgctattttaaataaggaattccgtatatatctccatattcagagtagatctatggacttcaatgagggtacttggggactcgtccgtttgtgggttcttactgatcaccatttatgagcatcatagtatgccagtatgacagtcaaaatctgcaaagaagacacagatgtagacagcagagttatatctggcatctcttctcactccaaggaatttattctaatactactctttataatgttctactgattatcagtgatttatttttgccaagccgctaaaccccggacccacgccgcttcccccgctacggctcgccgaaccatccaataaggacgccgatcgacgcgttcctgccgaagcgactcgcagagcatttccgtgtgtctttccttgcttcatcgccgaccgcacgcttcaccatgcccttcctcctcttctccctcctcatcctgtgcaccacccacgtcgcacgcgcagccctgcctcccgcctgcaccaggatcctcggcaccctcagcgaccgcctggactccctggcccactcctaccaggccgaggtctgcgccaaaggctgccagcccgccgtcgccgactgggaagaatggacctaccagcacgccttcctgccctttgtcgacaccgtcgcgacggagatgggcctgtcgtcgcgcttccgagaaacttttatccagttcggtgagcaagtcgccgccgtcgtgaagagggactgcgggccgttgttgcagggcaaacacttctgcgcggaatcagaggcattgaaccagtgggggagctgcttcaagaagaagtcggctgtcgtcgcgctcaagaacagtctcaagctgtttccgctggtgacgtcggagatctgcaagggagaatatacctatctggaaaaggacgagctgtgggaggtggttcttccggggtatatgaaggagtatgcagcgacgtgcaagaaggacgatacacatgacgagctctagacattcgagttctatcaatttgagtgatacgacaaaaatattgcatcgtctgtatatagtacgggcttggattatagataatcgcattggcgggctgctcagtctgaggtcaggtgatgcaatcacggaacatagcgtgctgtttgtgctgctcaaaccatacccgggcgcggaggggttggtctccggataccgggcctgaaactgcggcatgacgaggatgagggagacgacgccttggtctgcattcgtcaggagacatatacaatataagtaattagcaggctcataccatatccatacgaaaatccacccatggacgccagcagcgtcgcgccaaagacatagggcgatttgagcattcctttcgcgccagagtagccatagtgcacttcttccgcgtagagggtgggggtttctttggagacgatttcttcgtgcgtggttgttggcgtgagggggttagcgttggggtctttgtctttttctgccattttcgttgtctacctaggtttgaataaagtgtatagcaatgtactgctcagttcgaggacagctattctgcgtgaagatagagaagcacgtatggaaagagtaattgaggtatgggagaaatggatttatttttatttactgaattgaattgaaacaagaccatacaatggatcatgtctgccatgtggggagggagcacgcgatataaaataacgtcctgactgtagtataatttacctacctacctagctagctggatacatttgtatccccccagagggatacatccatctcccgtgccacatggagtagtcatctcgggccagcaactttggtccaagcttctttccattccagtcttgcttctgagcaaagtttcccgtttgagacaatcaactaaatcgaacatcctagcgtgcgctaataattactgaatttaggtagataggcggaggctttccccggactctattaccccggaccccgggataaataaggttcttaacccgcattttattgatgaatgttgtcgatctagcctttttcagtattgacactcttaggtagggctaggtaggtcacactacggttgagatttctgcgacggccgtcccatttcctcttctggatctggccgctttaatgagggcgctcgggagttgcgcagtgagtgctcagtaagtataccagagcactcactgagtaatcactgagcattacgtgattcagctcagcagctcacctggtctttatattgccttatggccacatttgaaggtttatatgataccttcctaacgtcccacccgcctttttgcgatgggctcacaaaatgagggacaaagaatatgtgcatttgaaacccttattactgtagtaagaaaaggcagactaatagaaaataaggagactaattcactggtcctactagattagggactatccttagattcttgtaggcattatatagagatgctacctatctcccttactagtatccttcttctgtaaattactcttgcttattttggcatatatagagtaattgcttataagtcattatatatatctttttttactataataccctctgagttatttttgcattattattataatctatggcctagagggatatagtactatcaataaagaaatcttagctaaagcaggaaagataaaaacaaagagctctttataaaaacaagaattataatagagaaacatgttaagaataggatactatttagaatagaaataaatatacaaaggaaagcaagagattatagaataataccatgcaatttataaagagtaggtatttactatctgtagttatcctctatctttgacttttatatatatatatgctaaactaacctggcaggttcttaactaaaaagaaagattagctaaaaaaagaggatctctagataggataactggcactaataacaccatcttctagtaccttgtgtgacggcacagttgttgtaataactatcgtatgtgagtcgccccttgaattgtgtgaagctatctaaggcggtgacagacggcagtatatggcagaggccgatactgcgacattgccaccacgaagaaatgctgcgccctcgctgcagatatctaaatgcaatacatacaatatcggcctattttctgacctatcagaggcctccatttagaattaatccaccgctaagcacgggacgcctcaaactccttgatcaattcttctgcgcccaccaaattcctctcatgaagccactggtcccctgcggctgtataccctttccaacgcacaagatagtgtgtagtaggcgtcttactgcgaccgtagcagcgtgttctcttgtcaagaatgacttcaacctcgtagcgatcagtatcttcaggaaagcgctcatccagcaccgcacctggctctgtagctgttcgtccgtagggatcgggtcctttgggagcaggttcaagatgcgcaacactgatgaccggatggattctccatgtagccgggatatcaaggcgataggcaagcttacccactcgctcaagaaccttgaaaggtcccgcacgcttgtctcgcaccttcttggcagcaatagcgttggctgggatgtcatagccatcaccaaggcagagataaacctcattaccaactgcgaaatgaacatccttatgatgggagtcgtagatacgcttcatccgtatcatcgcccaattgagactctccttcgcgtcatctctggatgcaaaatcctgcttgaatgctgagcgaagcatgttccacggtgtacgcagcttcataccgtacattagaacatgaggttcaactccggtcgagatgttaactgagccgtttagtgttgcttgaaaggatggtaaggcctgttcccaatccttatcaggatgcgtagcagcccaatggcgtaccatgataccaacggtgagattagtacgttccgattgaccatcagtttgttggtgataagcagtggcgtacagcatctgtactccgagtccttggaaaatagatgtccatagagcactcaggaacttgcgatcacgatcacatataatgacaacaggcactccccaatcagcgcgttgccagaaatctactaacgcaatagcccaatcttctgcagaccatgtagctttacctgcaatgaggccaatctgctttgtaaacttgtcagtctgtgataagatcgcgtcattgccacccttggagacaggaaggccaagaatgaagtcaattgtgagcgtgtgatagggaattggcggcgagaggatgggctgcaatgaaccgtacggcttgtgagtgcggggggcgtttataaggcactcagggcaatgtttgatatattcccggagacgagaaacacccttgtagattgcataccctcgcatcttcgcatacgcgcgatcaaaaccttgatgtccctgatcatcatgaaccatgcggaagatctcctgcgccacgctatacggaatatagagccaccaatcatctgcgtttcgtaaggagtatagaaggccatcttcttccttgtatggtaagactgtcttaattggatcatcggttggagctcgaagcatatcaaggatggcctttgcgcgatgatcctccagatacgcgtccttcaagcggtttttgaatccatcactcaattcaacaacagataggatcaaggcgtaagattcatcttcaacagtgacgtacaacacatcaagatcaggctctgaggacggcgtcatatccgcagcgggcaaccgagagagggcgtctgccaccacgttttctttgcctggcttgtggtagataagaagattgaattgctgaatgtactgtgaagctcgtacaaggcgtagattcaggcgatctgtggagctcgacgtcaatgaagattgtttcgcaatactgatcgtggcactgtgatcagtatagatcacgggaagcaggtcacaaggtgctgcttcaactaagtgtcgtattttccgtagcacccagatgaggctagaaacttcgagctctgtaggccagtaatgtcgctcagccggtgtcagcgtacgactaaaaaacatgatgggctccatcattgcgcggggaggcggcttcttcaattctgcatgatcgtattccttcttgacatgatagaccactgcgccatggccacgctccttagaggaatctagctccatatacagtctccgttcgcgatcatgatgtgctagccacttaggccgagcgaattcagcttgcagctgcataaaagagtcaagctcatcagatgtagggtcaagatatgctgtacgtgctgcaaaacgttggcggggagcacctttgaccggactgcctttcagcaaacgagccttgcgatcctgaagcggggcggatttctgcgcaaaatgggcaatatagtgacgaagagcgccagtcatgccgagatacgtctccagctctttcagtgaacgcgggaaagagaggctcgtgatagctttgagcttttcttcaactgtagacatgcccagggcatctacacgttggccaagcagctgaacatttggaaaaccaatgtacgacttgtctggtgagatagagatgttcaaatctgtcagcttctgaaaaagcatatggagatgctggatgtgatcatctaaggtgcgagaagcaatgacaatatcattaatataagccctgcaaaacatagccaattctttgagatgtagatccatttgtctctgcacgtatgccacagcgttgcagtttcccataatacagacgttgaaaatctcttgtccccgatgagatataactgcgatacgattgcggtgcgcaggtttgacacgccattgatagtagaactttgtagcatcgatgaccgagatgtaatgacagccgtttgtgagcttaataatgtcctcctgtgttggaacgggatagcagtcatgctcaacaatcttcttaaggttgcgtaggtctactactgcacgacctttgcgaattaccttgccgtcaggtttgatgacgtctttccaaaccacgaagactggaaaacaggtaggtgtgtggcctgtagcccactccatacggcctttatggtgaagctcatcaaatgtctcgtccaccacttcgcgatccttcgggccgaggtgatagacacggcttttaggcactttgctttcccagccttccacaagtgggatctccatccattggtcctctgggatattcacaaacccttcattttctccccaaatggcatacgcttccacaacctgtttcaacgcggccaccgttatatgatccccgtagacagtaataccgttagggagctttgtttcaagatgcagcggcgcggaaggtacagagatattaggtcgttcaaaaggggcaggctcagcggctaatcgtgcgagattggcggcatcgggagacacctgatatgcagtagtgaaagtggcatcctcaagcgttccaatacgttcatggcgagcaaaagtgacaggtgcatcttcatcattccgtgcaatgacaaatgaaaaattagaatcaaccacatgattataaagggccttagtgcgtgattctggggtgaacatatagtcacgatcgtcaggcagctctgacttgactttgataggaaccttaagagatgaacggggaggaatgatgacaacagttccgaggcttgaacattccacgtttcccccttgtgataacagggtttggatccggggctcgtagtgggagggcggctgaaagcgacgtgtaatggactaaaccgcctacatactttgcatgtacagtagtctaaactcccgcaagctgcaggacgcataaatttccgggattagcgccatactactagcatagatcacttccttccaactgaatggacttgctctaggccactatccgcattctgcgcggggtctcatccttttcttcgctgccggataatctcggcccctggctgaagtggacaggagtttttctcccctcgcactcgttgcatgaacgacggctagcatcgtgatttttgagatggtcagacgcaaacgccacagcggtgagcgctaacattgtcagatgctacaatatcacagtctaagaggccagcgctcgaggcgggcgtacgcgaatgtcaccttgtgtcggcccatgacctccaaccgctactgggtaaacgaggacatgacggagatatactcttcagtgtccgaaggttggaaattggaatgctgtctctcggaaatccactgtagacaaggcaccctatccctagggattccatgggtctacttcagctgcactcatattaaaataattccattggcattggagagctccgttctaccatttgatctggcattgactcaccatggtttcgttcgtaaaatggacgctcagcgtccttttgctctttctatgtctctttggtgattgttggatcactccgttagacagtccggccaccacgcccgcgttgtctggatggcggttgacgaatcgggcgttgcttgcacgccagttagttttgctgcaaaagaaatatatggttgatttagagactgacgagagcacagggattcggactcctgcactgcctatctcgacgaccctgacgtgcccgattgcgggcctctttgcggcccttctaacctggcatgtacccaagcgcccctggataagcgcaaccggagaatcttctttggaccggaaccaggggcgtggaatgaaacagacccttcaccagaagagctcaaaacactgcagaagagaacgatcactcctcttctgcagaaccaactcgcggattaccttattgatcaatttcaaggcaaccctgacccctacttcggcactccatcaagtatcgcagatccgtctgataacgtggtcaggcaagagttgttcggaaatacaccgtttcaagtgggcacgaatggcctctgcggatgcaccgttgtcacagtggtgtcgacgcgagcggtctacatggtcagctcactgcgctcatgtctgttctttctttgtttgtttggatttgaataactgatttactttttgtcgtgatgtatagggtcatttcttcgaagtcccgtcgtggtcgagttctgcatcggtgttcaagcaacgggtacttaatttcttcagcggcggcggccaagttggacagggtccagcaatgaatccagacctcttcactgccaatgatgacactcgtgtctacgtgatgacgccccgttcggcccggggcaattaccagaattaccaaaattcgaactattacggcaaagtccctcgactcctgaacaccattcgaacagctctgggaaatcaggatgtgcccattgctgtgtggaattacatcccattggaatgtgagatagacggcgagacaaacgatgagctcttcgaaagtgagaggggtgttgcgcttttccaattcgacccggatgcattcggcagtggagtacgagggtggaggatcctgtatgaagcactccagttcttgtccactgatccagcaccgggtgcagaatccgctagcggcgtgccggatccctagtttgctggtgggacgtaccctggattagtgatgaagtctaatgcaggaatccgacggacgaatgagttggtattggtcatggtcagcagcggactagcaagcaaagagacgtagggaatcgttcgcaggtgaccgatctgttggatgagtttgaaacatatttggcaaataggaaaatataaatatttttctttaaaataagtacaattcgcagtctcaaagtatttgtgaatttgatatatcacagaaactcgcgttccagaccttctctcgtgtgctgacgaaggtcgaccgaggacttgaaaggctggagtctgagagtcgcaagtcaagggtgtgacccgtatcaaacgcatatcaagtcaccaaccaggtgtctcgaagtttggcaaatcgaaccgtctcattgatgcaggtcccatgcaagattcgagacttgccccaaaatcatcgtcactgcatgtgcgtgatacagaatttgcagacttcgcggaaaaggcaaccaaggagatcaatcgagcaccaattcaaaatcgaaaccgtgctgtcggaagcccatgaaacctttccgtaattctctgattagtccctctgtcaccatcaatcgagtctaattcaacctcatcggatccttcgatatctcttctcgctaggatggtggtggtctacgcgcgttagtttatcggggtatgggataatgtaggtgatgaaaagaaatgggggaaagacgagagaggggagggagttgggacggttggaagaagtcaaggattggagactaacattgaggtcaactatgtgaagacaactcagacgacatcctcccttttctttgtctatcaagtcccagatcttccgagcggcctcatcaagtggaagatccgatcttccattgtcgacgtccaatgcaagttcgcgaagacgatgaagattcggacaaacgtcggagaggtcgcattcgtccggagcaaggacaccgggatatgggatagaaatcctcagatgttccaacagtgggcaatgagactcaattttccggacctcctctgagcgaatcgttgaaagtgaaggctgtgggccatagacatgtttatagggatgcaaggccagtctgcgcagtgtcgggccatgtcgctggagaatcctgtcaagcacagaggccgtcagataccctgccaagcgaacttcttttagaggctctaggtgctccatgagagactccaattcagagactaacaagtcccgattattagtggtcggttttaaacccatatcgagcgtctcgagagatgcgaacctcacgttctgcgtcatgtaaccgaacaccagaggatccgacacgtctcccagcattaaatagcggatcttggacaggtcggtgtactttggccactcccgtatgtcatccaatttcatgccccgattcccaaaatacgtgagcgaggtgagtgcacctttattggagaccttcaaaggcggcacgaatcctttccagggcacccgcggcctgttacgggcgcgcagtagctgaggggatgctcctgagcgaggtcttactatgttaagatgcctgagatttggggccagtgcgacaacctgaaaaatggcactcctgttataatcgacattgccgtttgaatcgaccccgaccgtttttacgctgatactgtgcaaacggggcgatcggatcaggtctagctcgtgcggatcggtgacggagtccccaaggctacgaagacggaaggaccgcatgtctagtcggcaggatggatggtactggtcaatagtctgtaataaacacggcggcagctgattccggcaaacccagataaggtcggtgatatgcttgcatttctgaatcaccaaagcgagaggattccaggcctcggagacttcctctgctgacccatcaggcagatcaaccgtaaaaacgcccccgaactccgcgtcatactcctctgaatgggcaggttcggcagccaattcctcccgatcggaagagggggagcctgctgtatcctcttcttcggccagtaagggcatacggccccagaccttgagacaccgagcatgaatcaagaactttttgcggaaaggattttcttcgagttcggcagagtcctcgcggagtttttggcgagaggagatttggagtgctagatttcggtaaaggaatggaacggcagcatgataacacgccttgttcactagtgataaacttcgcagagttttaggcgatgagagatagatctgtgggacatgagcaatagaaatcatcgcatatagaagacatcccgtacatcgtcaaagatcaaggacagaacgagtgtcggcagctcgtcaagtttgggaatcattttacccgaagactgtattgacaaactgtatgggggtctttcaatgcaataaagcttcaacgaacgaaacaagaagaacaaaatgattcttagaactttaaatatgtagtgaggcagatattatctatattctcggcgtaaggctgctgagagatcagtggggaaatagatgaagcctatctaggcatagaagatcaatatattcttgctccctctggaggagaaaagaagaactgactaggagccgacattgaggtcggctctatagctgcatggctagtttggcagtcacatagtaactaacagctaaattattcaggcctagcagctgcctggatgccatatgggtcaggcaccaacaattgggatatagtcttagtgcgatgtgaagggctttgcaggatgtggagtgacagccaatgacgagctctcttagccgccggtggagactcggtccgtcttgtcgccgggcaactagttccccagatattgtggttactccagcactctgtttccgtttaaacggtcaagtggttatgaaaggctgtcggactatattgctagctagagcggttgaaattgattgcgctagagtggaaagttggaaactgattgcattagagcggttggacatgaatggtcgaaggcaactagttgttgtggaccgacagggttggaagcagttggaaggtatctatatcagtaaatcaaatcaagagagctaagaccagttaacaaacagaagcaatttccccacatctggttaaagggcaaagcagtgcaaagcacaagataccagcctgatttctacagtatggactcattaccactatgcatgattatctttaacggcagtaacggcggggatactttttaattgaaccaacaattctgcttgaaattatccatcagacctactgggttacagcaagaaagtgagggacttttccctgtttctctttagaatatgctagttaaaatacaagggcattaaagagcaatggcaggtgggggccaagtaacgcagctaggtaagactataatcttggcacctaatattttattgggttcacatgattgtcctatgctcgtccttgctcagtaagcagcttaggaagctccaagattgctcaggctgtgctcaggtctgctcagtgagacaaaagcggcgctccctaagcactaaagcggaagtgcaaagcgccgaatgtctcgcagaaatctcacggataggtcaaaatatcgtataaaaatctgcgaactgctcttccctacctgacttggacactgccgctttaacggggtgagcagggtgagtcaggtgagcgactcacgcgatcgaggtgattcactcacccaggctcttttatactcaccccattctcacccatctcccctaaatgctcgcaccggttgtttagcaacatcaaaccaaggaactatgcagaggacagattggaaaacgatggtagtagtgggtcgtcccctacaacctccagggagaaaaaaagttaatagcaaaaatgatggtcttcgcccctctgtgtctgtttctggtcttatctttatttttcttctcttctatattgttgtaatcctacagacatctttctgtatttttctacctatagaatttgcctttttttttgtctcgctattggtgaaaatttgttgaaatgctaaagacaaagttggatagacttgcttgtgcaaaaacaaatggatacaaaaggtgcacataacaagagaaggacagtgtgagagccaaaaataagtattcagatcactccatcaaacttcagaacagagtcctggcagactataaaatgtaatgttcaatccactttcttttctgctacctactaattatactgaatagatgggcatcagaggatagtgatatgaataaagaagactatctctgtgaagggcaatctacaccatatttaaccactattaaagatacataaactctaccaaaggaatactctctacctgaccatattctctatactaaattttgccaaataattctttgctgggtttctttatattataaaaactatattaataaaaaaggatacagatgacattcattatataagtggttttaaataagttgcttttatactatatactaataacaagtagattaggcatactcctattaaggaagaggtcattaagaacaagaaatatgccaagtacatatttatatattatgacctaactaatattattgtttccttatagaccaacaatgatccactcttcatttatgagtgacacaggattcagatgacatttgctctcttaatatactactattctaatataagagtctctcactgacctggtttgcttgcttgcttcactggccgagccaagtttttttttttgaccgcagaaagaaggtgaactccctaatatgtatgaaatatgtagctctaataaagatccgtcaaaggtagttactgtataagcaagaagattacctaatcgatctgccataataataaaaaaataagattcacttcctgggtaagagacaagacatgaatagttactaaagccagaggaacatacctactggaagctatgctaggtatattaatacttatctcaagacaagccctctactactactttctatccttgttagatctctagtaattggtgtgggtgggtgattgattgattgattgattttattatctatccatctaatctactctactctggttatcagcttcaagaatgctttcgaggttcgatggttttgtatggtgttaatacagttcgaagaaatgaaatgaaacaaaaaaagagagggcgagagagagtcagttgaaggcaagaagagggagaatatatgtattatgtaggaaatgatgaaataattgtaattggtaatgtcttaatagaaacaaaccgaaaggaatgttggcgcgtgtgtaatgaaaaagaaatccatctgtcaatctgaagaccgaacgaagtcagtagacaatctcagagtccgtgaatggtcatcgaagataaccacatctaaaccttccaatcaggcttgcggtgaagcacctgcttcaccttctcaacaggcagaactctcgacacattaacccaaatccgtgaaccgaccccccgagaacgcagccagtaaaccgcgaagaagaggacggtgttgaagacggtgaacgcacatagatagccgaaatcgcgccagcggtcctcgtagaacatgttcacgcccgccagatacgcgtccgacaccgcgtaccgacagaactggcaatttgcagtggcgtccgggttgtaaatcgacgcgagggcttcgcgtgcaaagacccccgcatattctccgcaggtcatccccgcaggcgggttgaagatgttgatttccggctccgcgcatcggacaggaaccccatgcgttgcggtggacatcagcgaggaaacgaggtacgtaaacggcgacacgtagtaggcaaagtgccagaatccgacgagctgcgagagcggctggacgacgccggtgaaggcgaggatgaacgtgtagaagaggatcgtcagcatggccgccgtctcggcatctggggccacgatggccaggctctgcgagaagctcgtgtggtacagctggtagagcatgaagacaaaccacatcgaggcgccccggccgtcggagatgtcgcgccaccagccgatagggaaataccaacagatgaagcagaccgaggcaatgatgatgttgaacgggatctccgccacgatgctgccgaccacgaacacggtccagtggtacatcttggaatgccgctcgcgcacttcgtacagctcccggtactggatcagccgcggctgcagctgcacgatgatcacgagcgagagcaggaggagcatgaacacagagaaggtcttgttctggaggcccgcgaccgagttgggttccttgtagaaggtaaatccgaggaacaacccgcctgccaggttgatgaacaccttgctccagatatagactggactgcgccagtactgctggaatagacgccgctgcaccgccaggtactgatgcaaccagggcatggcatatccactcgatgtgtcggcagtgtcagtgttttccccagccgggctgccctcctggtgcgtcgagttcagtttctcgatttccaccgagacgtgctggaattccgggctcgacttccagacttcagcccagtcccgttcctcgtgggctgtcgctccggctccgattgtgtccaggatgtactcggcgggattggcattctcgggacaagatggggctccgttcctctcaaagtattggatcaccgtgctggcgttggggccaatgtcgccaaaatagacggtctttccacctttggcaagcagcagcagacggtcgaactgctcaaacagcatggaagagggctggtggatggtacagagaatggcctggccggcattggccatgtctcgcaagaacttcacaatggaccaagcggactgggagtcaagtccggatgtcggctcatccaagaacagtaggagagttggtttagcaacgagctccagcccaattgttgtcctcttgcgctgctccacgttcagtccctggccaggcacgccgatgacagcatctgcgtactcctgcatgcccaaagcggcaatgatcttttctacatagtcatatttctcctgcacgggaacttcctttggctggcgtagcagagcggagaatcgaagggcttcccgaacggtagattcggcgaggtggatgtcctgctgttgaacataacctgtttcctgctggaatgagcggcccagtggagatccattgaccagcatgttgccagtgattacccccaccgagatccgctgtgcgaggacgttaagcaaggtcgtcttcccggcgccggattctcccatcaaggccgtcagggtcccgggcttcacatacccttgaacgtcggacagcaaacggcgtgtctctcctttgagctcgatatcgtagttgacgtgcttccacgtaaagaccttttcgccccgggcgacagcatccatcagagcttcctgttgttgaccgactgccacaaattcattggcccggtcctccacgtcatcctctttaggaacacgctttgcggagggcagcctgggatgatgaaagaccagcgagtcacccttcgaggccggtgggtttttgaattctgtagcagccgcatatgtggccacaaaaaacacgaaaaacgcgatgcatatccccagattcctccaaaggtgggaataagaataggagaatgaaagctccacgtagtcgtctcccgacacgtacagctgtccaggacgggccccggtgacggcgcagacctggttcaacacgctcgtgtgttcatagcctggtccagatggcaccagcgtgttgcataacgcgtttctcccgtggaactcgacaaccatcagggcctcgatcgcgtaatatattgggttgaggtagctgatccatttgaaccacggatgcatggatggccggggaatgatatagccggcatagatgcccaagagcagcagcagaacgcccgcggtggccagggccgtttccgcccggttcgcgagagcagcgatcgtccgaaacagggcgctcatcattacagataccaggaaggtaaagagcacaaagagaaagaacggaccgggctcgcgcttgaaattggctaggaagtagatgatgacgctgaagactcccacgttgagcagcttgatcggatactgcaccaccatggaggcaagcgcgtcgatgaacggatggtacatggcataggatttgtgtttctccacgatcggtcgctgtgagaactgtgcgctgatttcggcaaagttgacgaggatgttgaagagtacagaaaagaagattgcgccgcctttggagaaaaacccgctggtgtcctcggggatgtcgtagaacatggacccgatgaccagggcgacgacggccatggtgacgacgatagagagtgtgtatgccttgtcgccaaggatgcgttgataggcgcggatataggtcgccatgaactgccttcccagattgagcatgtacggggaacggctcctggtccacgaggtcttctctgcagcctgtgcggacttgaaattctgcagcgcatcggagcagcctcgcgggtactgcttttcgtgctcctcgatctccgccatcagcctctggtagtagacgctctccttccaacgcgagacaaattcctccggagtccgaggaacacgctcttcgaagccggatctcacttgccgagcaacagggtcggtgatggaggtgagaaactcggccgtcgtctcgcggggaccgcagagaaagcccatgtcttggaagaagcgctttgcgtcactgagatcgccgaaccagatctggtgaccggcgtaaaggatcgtgactttgtcgtagatctcgacgagtgagtctcctggctggtacagcgcggtcactgcgacatggccggtcaggttggttgccacgcgcagggcacgggcaaattcgagcgaggtggatgagtccaagcctcgcgtcgggttatcccaatatgtcaccgaagcacgagtggccagctaataaaacgtccagattagacttgtgattccagtaaagacgaagacaaaggcgggacgaaccatttctgcaatcgagactcttttcctctctccaccggacaccccacggacaaagtcgtttccaaccctggtgttgaaggtatgcctcaaaccaaaggtagcacccaggatgtttctcatcttctcgatgtactcgtcgcgggagaggtggccgatcctctgcttcggggtcttggtcttgagggcgaactccagcgtctgggcaacggtcaggtatgggaaatggttctcaacctcggcattgtacacgactttcccgcggaaacgctctttcacgatgtcgattgggacgccgctgtacgtgatgtcgccagcccagtgggagtagccttcggtcaggccggcgagagttttcagcagcgtcgagcacccactccccggacggcccagcaccagcagcatctccccttctttgaccaggccattgattccgtgaaggatctcccgctgcgggccctttccgagaatgccactgacggctcgaaagagatccaggaagaccgacaatacatctgactgggacgttgtgacggcgccctctccatggacttcaacgtttcgccatctgactgacgtgctgggagaaatgggagccacatcttcatcgctcgaacgcttcaggacggctctgagggttttctcgagcgtccaagcggggtagtcggtgtcgaacggatcgtcactgtcggacgctctcgtgctgcgtcttgaaagtgcgtggacgagctctgcaaattgctggggagactcgttgattccatcgtcaagttgcgtaacggaagtctgctgactatctatctgcaagctcccaacgcttccaggatgggatttctcggcgtccatggtccctagcggacgtcaacaacctcgttccagctatggaattatgtgggatggccctcagtagatgttcaggcaaaaatgaaaggggataaccatcagcacttacctcactcacgacgaaatctgaatcgatctgaaggaaaaagctgaccggtgtcaaatagctgcaattgggaaagatagctaggctaatcgcggtttatatgacggagagatctgctggtcgcgtttgcggcagccgtgtctcggccatcggagttttcggttgacatatttgagagaaattcactcccttgacagggtcccgagacccgggtcctcgacagttttgcaacatggaagctgggtctctcatatcgaggttgatggaggttgcttggtacatactctgttcggcatccaatgacagccctggattctccttcggttccgaatggtctttcggcaccgagctttcggtaccgaacgcttgaaccatagtattatttctctcctgcattccggcactttttccattgctgtttctctttctttgccctccggatattcggtactgatagaaatgacggaaccgccggcgatgcggctttccaagacttgcgatgcctgtaaggctcgcaaagtccgctgcaccagtatgttcggaactccggttgcagcagttccgtgctgatggctcgcgtctaggatccagtgaggcggaacagtctgcatgtcacaattgcattgtaccgtgcatccctacctggacagcttttttaaccgagctcgtgctgacatcgatccattcgaacagtcacgaaaagagctgtgtcactacagctatgccaagccgccccgaaagcgcaagcaaccgtctgacgaggctgacgagaatgaaggtagagacttcctgtctggaacgaaaggctcgattgcttaccagacgatctagggtcacatggactgagttctgagactgttgccaaatggcaggcaactccatcgacacgagatggagataggaccccgtgctcaacgacggtagtgatcggtcaggagttgagttcctcaaatggacatcttggctccgtcagccatggagaagctgaatgccgcatgtctttttccggcggcaatggcaacaggtgtgttggcgagaaaacagcgtcgtcagaacagtctctatctcctaagctctacgtcgaccttctcctcgcagaccgtcagacacctgccaagcgcagagacgagaatgcccccagcaaggtcagctcgcttgggatgtacttaattgctctggagggtgctgacatcctttagttgaccgagttctttggtatggataagacactgtttacacaacagcaaaggcacctatcgattctgatttcttttaggaccaagttcgaacatttcattcttttctgccagcagggtgcattccctcagcaacaggcttgggcacacaaagctgaaccggcttatggagacgattggctcagtagcgaattcaagggtaaaaggcacaggccggatgctacctttgaattccgcacgggacttaaacaaggcaccgctgcaaatcagtcgcgacttcgcagtctcttgcatgagatgtatgctcttgccccaatcagtgccccaatcaagagacatttattaattccgatacagcttacttcgaacaggtccatccagtttatccgtttcttgaccgggcgtcctttgagcagaaagtctttggacaggccttctccccatcgtccgtaaccgatccagcttggtccgctctgtatcatgctgtccttgccattggctgtcagtataacgacggtggaagttttgacccgggcaatggacaagcttggagtctttttgaaatagcgctttcccactttcaggacattctgatgaccaaaggttctttgaccgccgtccaagtatgtcctcctttcccgaacatccatcttagacaaaagaccctaaccgacgcttcctggcaggctctgactgccatggtgggatcccctgactgtaggctctggaagacgcaggctgaaaccgattcgcaggctatcttctcgaccacggtgtctgcctggcaattcgaatcgctgatgatctccgaagcggccaaaatggcccagaacaatggttataacaaggcaaccggtccgaacgacagtatatgccatcgcaccttttgggttctgtacactctcgagaagatatcctgttttaccacagggcgaacttcggtaagctgtcatttaacaaaattaaacaagaaggcttatagtaacgaaaaaggttctcatggactctgacatcggatgcccgattccctacgttcccgagtccgtcttcggggattatgactggttcctcgcctctgccagatatgccaggctcgtctcgaagatctacagtagcttgttttctgtcagttcggcagggaaaacaacaggcttttatcacacctcgatttgccagctacgtgacgaactcgaagagtggaggatgtcgatcccagagcgataccggcctggcgaaccactccgagcacggtcgttgcctggcatgttggcagtctcaatcgcactgaccacacaatacctctactttaacgccctcctcaccttgctgcggacttccctccaggtcggagccgacgagctgggcaccgctcaccagctagcaacgaagaagttcctgatgaagactgcctgctccatcttggagttgacgacctacatcgaagtggccacctatacctccttatggtacgttctcctttcatcacacttatgtactgatttaagcgctggtacatgacatccagggtcctggcactcatgccgctgtccgcactcttcatcatttttgaccttgtcgtccacaaccccacccatccagagacgaataacaacctggcgctcctggacgtcgccagtggccacttcagtcgggtcgagtacgaaagccggggaaccctgccaggctccctggtggccgagtttgcgcacattgcacgggagtacgtgcgtgacgtgcaactgggcgagcggggccggaataatgatagcaatcatcaacctggcaatgggactacaagtagcaaaagtaataccggggtgaacgatgctccgaatcaggcacaatttccgagccctgtcctatctcagactcagtcacagagtcagggtcaacttccaaacaacgtgtcgtccgcagcagtcgcctctcagaccgcaacgacacgacaagctccagtgtccctaatgacgtctctgcaacaatgcgcctatcaccaaacgttcggcggatcgcagccgcaacaagcacagcaatacagcagcagcggtactcttatgaacgcgaacgatggcaccgggaccgaatcgctgttcttcccgctggtggacgatccgagctacatgccggaggaagagctgcagctgctggggatagacgtgatggatctgtttgacgcggtgaatccggccgttgttgggggtagctgaacaatgactgcatgagtacatacattgggtactattgaaactcggaaactttccgtaagcggtaaaaagcatattgttgatttggccagctagcattttgcatttacagtactggattatgaccagtttcttatcagggacataatgaattacggcattgttcctcctgtatagtctgtcggcagtagacgtagattttgtgcggcatgatatgtttatttaatctttggttggcctggtatgacctggatagacatatttcaataccttgttcctgcattgttctcttgtctgatgaatgtcatggcattgcttttttattagagtggtgaaaccgccaagagagatttgacttcttgatttgttactactttactgtctcatacatggtgagtcaacgagcatctggtgctgaggagtccgatagcccaattgctttccatcctgatttgaagcgaatgttggtgttctagggttcccagtgtctgtcgacattgaggccattttatgtttttttttgaggtgtctacatgcccagaatcttaatgtctatataatatcagatagtgatggctatattgatattcctgctatatagttacctagtagctggtatgtgatatagcagttcagaccctcacctagctcacacataaggaggtggctatctataagtactatcttaagatgtattaataatccaagctgtctgtcccttgtgttcctaatataatatatgaggatctactctatgctataaatattctattgcattctaataatacttataactggttacctttctgcgccccactcttatgacaactagtgaaactgggcccgataagtttactgtgccagtcagtctgcatgcttactctcgcaacaaggacgcccgtatgtcacagctggcagatatggtgtggtatctttgtgagaggagagcaggaactgttgcgaccgcatcctcaagggaatgaatctaccatcggtcattgaacgctttcttacctcattagctgcatttctttgtgcatctgctgttgatagctgtggtctatagatacatggaacgcatctaaatgaaatattttcttgagtcatccatcctccaaatttctttgttttgtagataccatatataagatataaagcttcaatcacaaaatatattttgactgaatctcctaactcatttcgcatcccactccaagagagcctttctacaatcctctcttcggaaattatccggccagccatattccctataaatcttcttcatttcctaagatcaggaatcagctcagcgttagtcctattctatcaaggaaacaaagggtatcagtcgaacaggcaagaggaaatgcgtacctcgccgtattcatcgtcaccaaaaaccacatacttggttgtcaccggcggcatccactcgagacgaagatagttgttcttccacttctcgtgtttgaatgccagggtcatggtctcgtcaatgcatagccgatctcgccagctgcgcgggtcgtcggcggggtagtttggggggtattcccatttgaagcggacgtagtctgataccgtttctgggtatatcacatatattagccctattttttttaaaaaaaaagtatttatttactaaacttaccatcactcgtagccaacatgatccagtgccccaccttactctccccgtatgtcaaagagatcacccacgacggaaacacgccatcctcatcgttgggatcataccatctgttccagcccgcccgccagtcgcaagggcgtgtccaatccgcaatgcagtagtcatgacccgtcttcttgagggtcatatcgatgtacggcaaatgtcggaggagggcgaccacttcatccgttttgggctcggaacgcgcgaagaccagactctctttggtgatatcgggccagccacccggtggagggtagcggatatcctccgggcccaaggagggaagagtggtgaggaattggtagaaggagaagattaatgcgatgatctcttctcggttgtagtggtgggtggcgccattgaggcgggggtctggagggggcatttgtttttttattatattgtattctttttggaaattactacttgttggaaagaaagagattgtttatgtagaagtacttctaaccctggcaattagagcggggtactgtgctaaaaaaagaaaggtagggcagagagactatatacactaagtccgtgttatatagagatcatctcctgctcagaatcctgtacgtcctccttcaccatataaaagggagcttcttatagatctttgagactgaaaattgcgaagccatccgttgctaaaagtcggcatctcttggccttgataagcagggagatttgttcagaaaaagtgagccttctctcaaataatgtcaccactaattattgtatccacttgtgtaatgcctcttctatctctggccagttcaacgcgacgtcttttgatattcgacgactgctggagaaccgtctaagaatgaatatgagtgtttttgatctcgaattatttcatctcaagcccgatgaaaggggctcagactcaatttcatcccgtagaaaaatcttgtggtcaattgggctgcggtttgttggaacacgcttgctcactttctggcggattacctggacgagcctagtggtacacgaataattttgatcttacttggaccattaacagcttcataagtagatcattggcgtgaagttggtgaagtttctcagccagcttaatgtgcagggttatttcatcacccttgttcattgtttctgcttcagtctgtgccgagcctccttccacagaaaattcaattgcatcaatatgggatccatatcgacatctttcctgcacctgagcaaaaaacaaatagtattcctgttgttccgctgtattcattttccacggtatgagaatgtttctgatgtcgatatcgacaagctcttgaaattcgctggccgacatacttaactgtagaaagatcatgtggtagtagcgaatggcaaacagagttgcacagcacagtcgtctgaaatcgtcagctccgcctccttcatctttctgcttaaaaacacagcatctctcaaatccgaactactcttttccgtgcaattcttattttgcatgtagcatcgagtatacctcacctgatgcaccatcttgtcacagggatgtgctgagcctcgccaaccaaaacagctgtctcagaagacatcgcagctgctgcccgttccgactccatgctcacctcagctggaagttctccattctccacaaagatagacactcgagagacaaagtccgccacaatcaccttgctatccttgctatctttgtacacaatcgacaccagcgctcccatctcctgtcccagaccctcgcagaagcagcctgccaggaccagcgcagggctttcaatgttgtggggaccgatatccttccatgatggcccgtcgtcttctatcttgccaaagttgcataggcgatagtagctctcgtcattctcgatcctgaaccagactgtatcccgcaacggagcggtcgacagcggcagggacagacccggcagagtggcgatgaggcctcgcgggctctgcatcgcgagcggagtcgccagcagggacggcggggggagggtaaagccctgggtaggcatcagcgaagacggcgcccagcggaagtatcgctgggtcagtcttctccccggagcaaacatcagatgcgccggaaagagtttcatcatctgcagcagctccgccatgcgatgctccggggcggtgctcgcgatcctcccggcatccaggtccagcaggaccgccaggcagaccggttcgtcctcctgcttggtggtcgtccgccactgcaaggcctcgaccagctccaacacgcgttcgctttccaggcgtttaaaacgctggaagtattgcagagaggacaccacgtcaacggtgggattagctggcacgtcgaccgcctcgtctcgctggcttgcgtcgatcaggtcctgcagtgctagagcctgctccttgaactggaagagcagctccttcgccaatgccccctcctgcagcgtccacaggcggcgcatccacccggaacagacgattcgcatcaagcactccaccggcgtggttctcatcgatgccgtctcaagctccccgtctagcacgagcactttcgccgcgctctcgtatgtcctcctcatcctgccgatggccacgggtcgatactctccccggatcgggacacagagcgtgtcgagccagaacaaacccggtttgtcgtcatcgttctcgatgatcattgagacgagaaactggatatattggagttggcatgtcggaagggcattggcagtgacgtttccccttccgtcggaccagacatgcgaaatcgcaacgtagctgggagggtcctgaaggtctgcctcgaccgtctcgatcgtgcagcccttctctccatccatcacgagcctcaccaggggaatgtgtccattcgcgagggcagatgccaagctctcctcaggcggaccgatcaagtcacagtcgcagctgtcgacgacatgtttctggcgataacggtccttgtcgagataatgcatattgcacctctttgccgagcaggttgcatgcctcgccattgtcgaatagtccatccgcaacgcgctggcatagtacatggccgacgaggagagcagagacgacagcatctgcactcgattgggacaccatccgtccatgcgcatccttcgcgctggccatgtgcttcgacgccaggccttgggcttccgctccgatgtcggaaatacacgacgatagatgcggatggcagcatactcgagcgtctcgcagagagcgatatgcacaaacccgcctgggcccagcgggtcgtaatcagaccgctcgctgtatagccgatcgacaatgagcttcgcgtcttccaggacggcctgtacctggagcgcatgctgctctctgtcctctggcgaagcctgctcttcacgggcagcccacacgcgcagatacgcgggcaaggcagcggttgtcaggatgtcccgatccaggaggcccttggtcacaaactcggtgtgctggatcaggatgcctgggatttcgaggatcttcgataggaccccaaagaacagccactcctggacgaatcccttcatctgccaggcgtcgagatcccccaaccgtcccgtcgtgaggacggcatctttatccaggccttttttggccgggtagtctagcagcgggcagtcgatggggaggcggaagttgggatcgcagagatattcgacctgcggatgcccgaggagggggtctgcagggagagggaggtggtccatggcgacatagaacttatcatacacttgaaatcaggaggtgactgtcgccagggatgtagaaatgattagctgttaatggcacacaagactgcggctcaaatagtgctgctggcaggcctgtcttgccacacaactcctgcagagagaactggtcttgccaaggggatgatagaggatatacaaagtatcgcaagatgcactgcttgtcaacttgctgcgttggaccaatgacatggagagaaacaactaagtcagtggggaaaaaacgattcgccctcgtcagatttaatttcctgtgggagacgtggttacaagatcgacatatccaccgctttgctgggagttgtttaaccctaaaaactacgtagtataattcagggaatacaaagcggaggtacagtaccaagacaatgatgatggctaataggaaatagatctagcaaggcagaccgcgacacggcactgactatgtactgtaaagttattttagaattataagaggtttttggaatattgagaagctttaattctcgtgactagtataagtcatagtcttgagtgttaaaggaatacttgtggtgtggatctattaagccaagaaaggctaccaatggcttttcccactctgtgatgtttaaaaatataaatagcaactaagtggagataaaatatgatcatcataaatagctatcgtataagtatctcgctttctctacgtgtgtgttttttttctatttccctactatctacacttgtcctccccttactcttccactttcctcgagatatagcacggccatctatattgcactggcgtagagtaggattcacagttccctgcagttccattctgtaataactattcatacttcagaggctattgaagaaaaagtattcaatttcatccactacatataaagcaaaacatgaacgtagaaagatgcttgattcctcatcgactatcgaccttcgtctgcgaggccatcgcagacacattgctggtaggagactcctctcccaccgtcatcttgggccccttgaaccatttccttgcaaagagagcatagtacagcagtgcgccgccccagagcgcgccgttgatcacgatcgtgtagttcatgtccttggctgcatccacatctgtcagcagctgtacccatacgacagaatttgaatggaggagatatgatatgtcgacttacgcgacggatccggccccgtcgtcggaaacatagacagcacaatcgcaaaaacgagatacacaatcgccgtcacagcaatcggcctgctcagccagcgaccggtgtagaactcacccggccggaacttgccctgcttctcgccccacatcaaccgacaaaagatgggcatgccccaggcgaggtcgttgcccgccacggcgagcgagaacagtgcgttcgatgccgcgtcgttgatcaggcagagcaggcccaggatcacggacatggtgaccacgccccagatcattcgcaccggttggtagcggatgcgtttgctgacgtgccgcaagaagcgtgagaagggcagggcgccgtcgcgagagaaagcccagctttggcgggaggcagcgatgacctagtcagtcagtacagatgacaggaaagaaagggaatcaggaggaaatgaattattactgaccaagctcagtcccatgaagaactgcacgaccgcaacgacagccatgaagccaagggcaccatgtttgccgagagagtcgtagtatatctgttcaggttagacagcagcaaacaacgagaacagcgactggaaatacctgagccatcggctgcccaaacgaagtaccgagaatattgccgatcttcgtatccatcaccgctgcaatcaccgtcagcgaaacccatcccagcacaccgcacatcccactggaccagacgatgcccaacggcaccgcgcgcgaggcatgtgtcgcctcctcgctcatgtgcacacacgagtcgaatgcgccaatcgtccagatgggcgagagccaggcgagcatgaacgcccagccggtgggccaggaggtgaggttctcgacgtccccgaagacgtaactgccggagttgatcgggacgtggttgacattgttgccgattgggagggcaatgaccgtcgcgatgacgagcccgacgttgagaaatatgcacatagcctggatcttgggcatgatgcgtccgaaaaacgtcgcgatgaggccgtgggtcgcgacgcaggcgacgtacgtgccgtagacaactggccgggaggcagtccaggtgccgtcgcgagctagcgagatgacagagagcagcatcaaggcgaagctatctacgccaagttagatctcagattcacctacatagcgatgctgaacgcacaatcaaccgagcaaacccctccaaccaagccgatcgtattgctgtatccaaccacgaaactcagcggattcctccatttctcagacgcgaagtaatgcgtccagaagtagaggccgcctgcagtcggcattgcagacgccagatcggcctgcaggcagagcacattattagtccaccgttgaaaatgcagtcaagaggtatttaccatagccagaccaacgatggtgatgaagatactcgcaagaagccagcctaaaccgtagtaaatactaagataaactgatatcagaatgtgtgtacataccctgtcagcagtaaccatcagtatacgacaagaatttcaccagtacgtgtctatttgatacatgagagcatacccaaaccatccccaccggccccgcaggcagcgaaaaggtcagcgtcgacgcaatcgacggcagcaggcccatgatgctgaacgcgatggcgaagatctcgagggtggagtagtggcggcgcagctcttgtttgtagcccagcatcgctagcagatccattagcatctatcactacgtgtatctatgggggttgggattctggttagtattcgaacctagcatctctgaatcgcctgctctgatggcgtcgtcatggctgttgcgctcgtccattgtacctgggactggagtcgcagcgggagccttgtcggctgtcatggttacagcttgaccgtgtttctctgggtccatggtgaatgccaattcagtagagaagaaagatggagaggagagatcaattgacggacagtgaggtcaagtcgctgaatggaaaggggaaaagaaaatccaagattagtagcacagaacaagaagagcatgcgtgggcataccttactttagcatgtgccgcagtgaattacatatatgtaagaaagtaagcatgcatgcatgcttgcattgtagcacgcagcccggaattatcgccataccctcgacggctagccacagggaccgagcgacggaaacaaagaaatgataagataccaaggctgtgcaatgacactctgataagaacacgggcaaacacgagcaagtctcagccactgaatgataatattccgcaactggcgatggttgcgtattagactagcttatcaaggtgatcgtttccccgatcggcagctggcagttatcctgtctgtgctatcgcgtcgcgtctggggtaattgtttacttatctgtcacccccaccaaactactccgtagacgatgtaagatgctgataagctgtcgatgcacgatagcgccgaaggaaattgattggatggaatttatcgagtttgaagctgatgtcatcgtgttggtggactacataataggattggacgattataaatatcggctcaaattttctacgctctaccagaagggagaatttgttcccgtacgaaagcaaattctaaaatttatatatctagagaataaatatggaatgataggatgtctaaaggccattacgatgcagattgtcagtctgctcgatgcatggatattatcgaccctcgctagttaatcaatctttagggaaaagtgtttactctcttcgatctagctatccagaaaaatgccatctgcttcgtcaaaggcgcagctctgcatgctgccactagttttattaaactatattatcatttcccctggatatgaaactggatattccgtagcaagtatcgatgaaagcagaagctctcatattctatgccctgctctgctcttacaccggttctacctcacataatgctgaaggctatatgcttcgttcagttgggctcgcctgccggaggcgtagtctgcgttggcgacgccagcggtgattctgaatgctgcttcgcatgagcaacgtcattcgcatggccattgctggaattgacagccgtcagctcggacatgttgcgcgtgtgacgcgggccttgctggaggttctcgcctggagtcgactgcgacgctgaacgctctttctccatctgcgcctcgagctcgttgtagtcctggcccggattgcacgtctgatatcgcagctggttcagtaggtagaagaacgcagaggccagaagcgagcccagcagcggtccgacgaagtagatccagaaataccccgggaagtggtggttgaccacggcaggaccgagcgagcgagcgaagttgagcgagccgccggtgtagtagatacctagacacatcagtgatggaacttgaaatcgtctgttcttcggttgcgtctatcttaccagccagctcagtgacaaagaatgaaagaccaattcccaccggcgccaaaaaggtcgccttgtgcttgacagccgccagcatgatcaccacgaaaaccagctgtgtcgtcaggaacatctcgatgaacagccccctcgagatggaggttcctccaccgagggtggtctcgacattgagggagccagggaagagacatgacacgacaccggcagcggccaggccacccaggatctgggcgatgaacaccagcacactgcgcagcagcggcagtcctccaaccaggtagagagccagagtcacctggagtcattcaagttaatcctttccccgttttgcctagataaaccaggcgattgacataccgacggattgaacaggccacccgtcacgcgatagaaagcccacacattgactgtcagcgagaagccaaaggacagcgaggcatacagcagcgccgctggattgggatcagcgccttcgggcggcttaggcgtattggcgatctgcgtgccagcaaaggaccagaagaggaagaggaaggtgccgacgaactcgcccagcatggcgacgatattgttgcgagtcgtatcagccaggttaagcattggaagctgcatctggctgcgctggcggctgacggacgccagctggtccgacgaggaccctgagcgggcctggctgcggagatgcatgatgatgatcgaatattgtctctggatggaatgattgatcccttcctcgtctggaaaaataccgagacaagcagatgagacaaacttacttcagggggcgagaccttctataaattattcgccatgatcctgattgtatcgaccagacgtcatgactagacgttgactttgcgatactggcatagtggaactgtttactgcagggtctagcccagcgagaagtatttctcgatgtaacgtaaggagccattcagcccagattaacaacaagcaggtcaaattagtgccgaaacgaaaggatagagtttgagtgagtgcaaaggctgtagctctcgctagtaggtatgtagagctccttgcctgtgaagggaggtcgtgcaagaagaagcaagctcggttctccgcaaaaaatatgacagtctttaggacccactgtctctaaacgcgctcgtcgaccaacgcatagaatttttttattggcatttccaacaaatatcatgccatgtatagatgttgtcattcgctgcaataggtggtctctgcggaattagcggcggctgaatatttccgaaatatatatatactacctgaggtaaggtagggaactttatgctcaaaccaagcttatccaatttctgcagggtgctttgaccaggaccaagactgtcaggtaaaataagcttatggatatgagttactgcctcgctggttggttgcgtggtgctgcagctggcgtgagtatttccgcaaacggaaatcctcagctgtcactgtccacgtccaactttaagatctagcgtaacctatcacattgcttaaaaaataaaaaagagaaaaaaaattaaaaaataaaaaaaaattgctactacttggcacctcattcgtgtaacttacggggtagtatcgctacctgaatggcagtcatgacgtccttcatgtggccgagaccccttaacgagacgacgcatatagactacaccctccatgacagacgagaaaaaagaccaaaaatgacgaaattacgttgtaaattgtagaaacattagggccaaaaaaaagagagataaaaaaggccaaaggaagggagaatagtcaaagacgagggcaagagaaatgtcagcagcttgagagatgcggattgaaaggacgtaccaaacatcacctcggatttgtactatacatacgtcgctaactcgcatacgcattctggcgagctcatcgatgccggtccagacgcgcaatcaccaactggaattccatatacggcaatgccaagctcttcccacgtatcccacgctttgggtgtgcaaatctcagactggggctgacttgtattctagagaactactaattcgttattcgaagatgaaagtataatggtgcaagtgaatactcgtccacggtgttgtgtgagagctcaacaatgctctagcattcgaatgactttctctgtcagagaatccacgaagcagacttactcaatcatatagatattaaatggttgggcatagccctactgtggtaaaatgactaacatactgctatcgactgcctcgtcgagtatacgcaggtggaggtggtcttgcctttaacatacgaatcccgcttcatcgagatacaggaattttaaactgggatgaggactgcttctagggagtgcttattatttttactctataaatcttgcgccaaattcgagccctgtgagaggtcatgactgtaacgatgccagtcttgaacagtcaggggcactatattttctcacatccctatgaggagcgagcataggcggtatgactaccaggagcatatctgggctcataccaaccgaagagcgtagcgattgcaaactgccgttgccgaactgcagcttgccttaaagagcttctctatgtaacaggagcctgtttacctatttccactgcacagaagtaacgaagaaaagaataggaccaataaacacactttatcaatagtcccttctagattcacttgctgctgatctgagaaagcgaaccagatgcagttgaacggcggtttccgagcgctgtcatcagcaatacttcttaaactttcgtacggcgtgccaacataactgcttccaagaaaacagatatggaatacggaattatccatgtagctagactggctaagaactgctttgtctactcaggagaactatgccagaaagtgagataattctgcaggattccgtaagacctagcggataggcgcagtagaaacccgagctgcaactgcatcattcctgcagcatctacagaagtggacgggtggtagagaaacgaaaggaatgtcttggagatggataatgccaggaagatacatctgaaaatccgacataggtacgtctttctagacgaggagatttgtcggaagttccctatcaactctctgtacaggaggcagcattccctgcagcatcctggccactgccgtatttaattcactactcttcggaactctccgcgagatcattcacctgtatggtaatttctgactctattcgatgataggatcgcttaatctcgcttagctaggttgctggcattcactgccttcctcctgccacggctggctaccaagaaaggaatataaagaagcacaactcccaccatcccacacctcaaaaattttcttcttcttttctcacacgtcgctatatagcctgctctatcctttttcttgtctggaggaactataatatttctaatatagcttatcatactacatatttcttaggggtctgccctctcgtccatctgtctctttaaaaataaaacttttgatgagtagcaacatcgtgctgccttcaagaaaccccatcattattccaacttgcctgaaatcggcagaaacggaccacatacttggactggagtggccgggccgatgcacactgcgggcatttacgctgcactaataagtaggtgtcgagttcctctgaattctctcgtcttcctgtccctttcatagtgcataactgaattatccagatatccctcattgcagacggtgtgtcccccctgggacagcagctacatgatcatgtcgctgtgggggagcactggcagaatgccgacggaaagcgtcgcctgtaccaactgatacggcagcatccacttagggcgtccgagaatggggtgcttgaattcataagcataatcaatatgccagaggtgagctactattctcctttctctctcaccctcaaggaatatcctgctgactaggaccttgcaaaatcaaagaggaatccctgaggacatcatgcacttcaatggtgctttttcatgctccatgttcccatgagtttgtccgaaagggcatgatcaaccagaagcaacttggctcgtgaaggacttgccatgcctgacaaccgttgggatcgacttttccttgctctctcacgcttggccaagtgggccagcgtgtcgaatctcattttcttgctgagcaggacagctagtgctcgggggatcatcagcacaagcatctacttactcatcttgactgggtatgatgcgcaatattattatctgcaggcagacatggacaacctgaagatggtgtatccaaccagcagtatcggcggcgttttggttcagaagatcgacggtttccagggcggagaaacgccctttgtgaagctgtcggattcctgtctacatatcgtgatggagacattaccagtcaacgttcgatccgaacgctggcctgccgatatagccaagcagggatacattgggcggtatgcttactcttcaaatttcccccttaaagacctttttattaatacgaccataaccttccaggtcttctcagtctcccaggaccaaaacgaaatttacttggccttctcgacggttgatcgccactacggcaaatacttggacaatgggggcaggactgaacgctttctcgaagttcaccactctggtccatggaagataaagaacgcggatcatacttgagaagatctaggatagtgagccagttacgaccacttagcctcagtaccgatgtttatcgacgatccaagaacgggagtgcctctgtgacgatctacgggggatctccattaaatctcaaacatcctttcggcacattggagataacttaaacgcgtctggtaggtttttgataaaaaatgaatcgtctcatgcagggcccaggggaagcacctatccgaccccaggctgatggaagggtccttcgaccaccgcgcacaagtgttatgatatgaagtcccttatacaggaggggacacgcaatgtcagaaaccatggctggatctgaattgctacgcaacgtccatctctatcacgatactggaaatgtgcgggccttacaaaggaacgggccagcaatgttggcaatgtccaacagagacttgtaagtcgaaccacttggagagatttatacttcccactctgacatgaatcacaaggggtatggtatagtctatgccaggaggacggaaatctccaacacctttgtgagagcatctcaaaatgcaattgatgggatatcgcacaaacagaagcagaggaacaggacataccggagatatcttgaggcataggcgattctttagcagttccagtcctcagtgtcgctcctggcggcagcagcatttctacctttgaagaaccacctgccggagaatgacctctttcctcagcttcgccaggcttccgcgcgtttaccgcaataagatcaacgcataaaacatgttttcatattgatgttctgtcaatttaaccattcaggttgacatgacctaggtcaaattgcagaaatgaggttatgttctattacgttctggtaatacatacaaactgattgcatttctgtgccccagccttatgacaattagtgagactgggcccagcaagttcccccccccctctgcctccggtgagttcgcaaggacagagtgggtggcagagctaacgcgcgagcagatggctgttgtctccccacccgagcctggtgtgttgctgccagcccccatgcctgtccatgtagcggcctcaggaataagtgatcagaatggaacatgggtcttgtgagggccaaagtgcgttcgcagctaacaggaggtagccacccgtgctgtgccaagtcagtctgcatgcctactcccctatatcatagctggcaggtatactctctttgcaagaggagaacgagaactgctgcaactacattgtcaaggggatgagttgaccatctgtcattgagcacatcatcaccttatataactgtttcttttgcaattcgcacccaacatctctgcagtgttgttcaagccatgttcttgatgattgcgttccctggaatggatgaaggacttgggcatggtaagtgtcttaaagccctattgcttatgcacagcaccttatagcatatacttaatgatcaatcatcaaaccagctcctacaatgagagcactcgtgaacaaagagactacaaagatatacgagaacttgttgaaaaccatctgccgccttcgccttctgatgtctcttccaggactgcccacgtgaaaggacattagcaatcatggatcccaaaatcgaacaaaattttacgttccagggatgtcacattctggattggggatcgacgtcatggttagtgatcacattaatatctacatcaacaggctgtcgggtaagccgaatgcagcagctactagagctccatcccaagcgagcattgctaatacttcattgaattggtgcaagtgacaccgaataattcctgtccggaaacaatgagttctgcctattctcttcgcaggttgtttgtttgaatgttcgcagtgtcttcctcatcatttgtgagtttcatcgacatgctcgcaagagttccatataccatgctctatgttcgcagtgttactgaatgttcgcgagtcgaatgacaatggcgtcccggcaccggccggccccctgcatgcgcccgcgaccaattctcctgtggctgccgccccgcctatgtttcaagaatgcagagacgcgctcatgatcccaatgaaggagactgaaagatgctgtcgtagcaccggatgacgataacctggcagatagccagcatttggatggggacgagatacactgagagcgcgaggtctggcacggaaggcgactcccatgaagctatcgtcaagcactctttttacgaatcgcgggcagattctctcagcggccgcaaaggcgctgccgtcagactcggctgcaacgagaacgctggtcactctgccgacgaacggtgagccgacgccacagcaaggacgatatagaaaccaagtgggccgcaaccctaactgggaagcggtcctggcccaggcagtgggaaatgagaacgcagcgtcgttcatccttgtccgaatcatctgagtggaattccaggaatagaggttgtcccagcaaaccaagcacgggaacaaatactggagcgaaagtcggacgaagaaagaatatgttgaccaacatgatcgccctcgccatcgaagacaatattcgccgcatcatgactaagggctcccatgggaagaatatgatttgagcactgcaacaagacatttgcttgcaggaaaagaaacagcttctctcacacccgctcccacagttcccgtacatttactcctgggctaatcccctgctacaacagggctagtatgtctttctattggggaagggcaaaaatcctcatgaaggatctctgcgatgttggtaactttgtcaatgccgctatccaaaatcacggttaattcaacgcccgggaaggtactcatatgctcttactatgtcccttctgctgggagtaatacgcaccgatgcattattctgtcttcgcagtttatctgactgcaggctctggggagtatcctcagcctaggcccgacgtccattgtgtgctgtcttcacgtgcttcccctgaactgattgctgagtcggctgcgccctactagcgatacatcattgcgccggttggctttatctttgcccatgctgtggaactggttgctggcgaagcatccacctttaacaaagaaaatgatgatctctccaatttctggcagcaagacctcttcgctattaccacacggatgcgtgcctcaaggacccatggctgaccgactgatcgcacccagagataatggccacgacgttcgggttagcatcggtccaccaaatcaatacgaggatacttatccagacacgagtatccaaacggtagttggagaggttgaagcatggcactgttggatgctccttggattgcggacttgacgaaagcacattctagagtatacttatatcggaaacggttctcacttccttctccccaatgctgatatgtctaccagagcaaattacgaacacgttgaaccattgcagttatcgctatggtttcatggttaagtctctcaggcatacaaccaacactcaaccttatcactcacatatggaggtgcttatatccaattctctctgaactgcatgcgcaacatcgatcaaacaaatccagcattgcttcacagaatgggaggggattatgcctcggcaaagattccgactatgaagaagactatctcaaacagcctcattcgaaacttgcaaaagcatacagggcataggaccgagactctggttctaatctgcagttactctgtgattagcaccggatcgaagctgcagaagctatgctgcaatgctcgccatattgacaattcgatgtcaatcccccctaccgagcaggctaatggccgcatccgacgtctgggacaaatgcacatcgtcgaaaactgcaacgagacggtcctgtgcagaagccgccgaggctgacagtactcgctgagagttgacagtgtctcaaagcctggatatcccagtggtgataagccaattccaactgtacgtcttctgatttgggaggatttcggtggctccttcagcaccattcaaggacgaaatccaaagtctcctgtcatcagatagcattccaattgaggtagtcaaccctttgaagtgtttccaactttctatttctgcagagactatccaaaccaccgccagtccacacgccgcaggcccaatcacagatagaccttttcggtggccacaaaggcgcaacgatatccctactgaattgcgtcgatctggaaaattttgcgactcttttggagcaaggagcaggtagatgcatggtatcaagccatcttcacccgcaccacagaagtcgtggacaatttgatctgccttgctcctcatgctgataagtatcataaatgggtacactctacacttcagccaattatatacaaaaagtggaaggtgaagaatgacattctaggcagcagaatgatgcaatccttccacactgacttacgccgtgaactagggccgattcctgaatctagagctgacgacctttgggagcgtattgttcgcgagtacggaatgttgctagcaaagaatgggtcggcgaggtcgtcatacctagtttagacacatcgacatcaatgtgcctgaaaccattgagacagggcaaaggctcaacattgcactgtacaatggtcgttgtcttcggatgacgaaagccctagcgactctacaagtattcccgggcacacatcaacacctttctgcaagcttcctcgccaatagatatggcctaattataaaaaccgggccttttcttgtcatccacaatttcctgtgacattgtggcgtttttggggggatcactcatcttgctccagatacgatccctacgaagtctgcgttgctgggagcagataatgttctcatgatctattcgttcaatcgcgatatgaacatggattacggacccggattcaccggtaaataccgagtccatggtccttgcacagggaaaatcgttattcgactactgaggatcaagctgagagggatccaaatgatccaactcatctcatgccagatttacaatctatgttccatatcacaccagttatcttccccaacatggtagatgcagaagagaagcttgaccaagtactacagcaaccctgttcctgtgctgtgactcgttcttctcgttctcgttctcatctacaagttttcgatatagtgcttatgcatatccttcaaatgacccaccggaagtgggctacgtgatcaggcccaaagatcatatcaatacaagatatgcggacctgaacgtctattaccataccgcagcccacggcaacatgcacttccttcttgtgcaatgcaagaggccggcatatgagaatcaggaatggatgtagaaagacgcatatctacccacgaccgcgaaaccttacgtgagctatactaagttgtcagggtcgttcgaacgttacagcagagattgaattgtatgaagcaagggtcttgtcgtcttataaggtcctacaagtggctgaattgcgagggggagctggatggaagataagggagatgtttgtggaaactcagggaatgggagtggataatgcaaaaaaaagagagagaaaaggggaaaaaagataaacaagaaacaaagtccttgaggattcctttcttgtggtggaagaatatgatgcacgaggtaagtactatttagttttccagcttctcaatttgccacggtactaacaaatagacatgggctggtcaatttctctttcagccggcaatctttttagtcctcaggtggaaatctctctcgctgagatggatgttgacaaatccgagaccggccttcaaatgaagctcgaggacagccacctgctgctgactgcgggctttttgcgctgcatacaatacagggttttttttacgccttaggcttgaactccgaggccagggtgtgagacgatttgacgaaaaagtggaacggagatcatcgaatttgccggatcagtccctacgggatcatgcgggacgccttcaaaacctgtcatcaaatcagtacagatttatgaagctacagacgagtgcgttcacgtctatgaaggtgtagacgttgaggcagttaacagcgttgccgaggagctcgaccgcggggacctggttcggcgggtgagggagatactgcctctctcctcccacgggactggttccaatttgctcagttttcggccagtgcaaaaaaaaaaggcacgttgttgaagttgtctacgcttcgcgcttcattggggcagcaagaaaacctgaggagagcatgctgcttgtcggaatgtccaacgattctgtctcatcgaattcttcgacataagcaatcagccagctgatggccaagcgctatgaaccgccgaaatccaaagaatggtttgaaaaacaggtttccatcaattaacaggagaagcaaggagattggccgcatcaagcatattatcaccctgggggcagtggcaagctgatgcagtctgggagttgatacagagcaagtggatcgaggcgaggaattcggaagggaagattggtgggctctggaatacaattctcagccacgactttcccccagttgctggccgagcaggtcagacaacatcatgaccaaaatctctaccatatcatcatctaaactacaggtttcattgatatagagtgggtcagtaccttacacaatctatgtcttcgtctttgaactaacttgatatatccaggaaacagaccagagagctccatgtgaggagtccactctattttccctaaaatctggtgggcgtctctttttgagaagctgtttgagtccatcagtcgcaactctacatctgaagagggcatcagctttactgtgctgcaaatacggacatacggagcgatggcttgtcctcaccctacaaggataatactaagatttttgtccagtgattcttctcaatattttttctcacctggtcccggatgctggaagagctctttggagcacacttatattctggaggctcaagatgggatgggttgataagcagtttgcgaagaacgagagtctctcctgagatccagctaattgtcaatgactgaaactgtatttacccagctgcggaagagtaagattttcccacatattaactaaccggtatcaaagctaacatggcattgagtgacagtgactcgaggtgctgtgtctcgacgaacccgaacattcttttccaagaaccatctgacattatatctcttgctttcggcagagcaacaagacgcgtcacgaaattcccaggccatcaggatgcttattaatagtgacaacaaaagcttctttgctcgtttgttacacctggcaaggatttctattctcaccacccaggaacatgacccctgcaagaagctgttacattatatgcgggaatttaacaattcggcttcgaggacgcttttgttgacaaagctggtacgacgtcaaagttagacgcaactattaatcctgtgtctcattctggtgtcagggtccaaaattgaacgacatattgtcactaccttaacctgctcggaccaaatcatccattggatggaatgcaaagaaatgcactggattcttcaccgagcacattgtcaaatcgcacaacatgccggactcctaagcaaaatcactgcgcaacatctctccataccttgtaggcgattttgagacatgattgaccttactaataagagcatcgcacacagctaacaagatatgtgactacatcttttgggctatgttgcgccatccttgacacaatctgaatgcgcttactgcccacatcggaatctgcaagagatatttgcctccagtacccttgtatatcggccaattcacgtgaacaagcttacttcatttggctcgagaaagtccctcggcggatatcatgcagatgacgtagacggtgtagaaggcggtgtgtgtttgtgccggcagaatttctcgatatcttccctcacccactacgcctcgatagcttccttcttctcttttcttctccagcttcggatcttcgttagatagctgccaaatgaactgatttcacttgtttgagccgtcacagttctacccaagtgaaacttattgttggcaattccacattcctcaaccttctgtggaacctgattttcaacactgctccagtgaatcccgccactcctttgctcagagggtttataatccctcgccaagacttgggggcatttatccggcagtatttcaggatatattgcgaatacatgtaccgacatctattcaagaggttccctgccggctctcctttcttttcgtccggtctttgttacggtgagagcatctgcccttcgatatttcctgttgggcatatcctgatcatcccatttgttgaaggagaacgactgtcaatgttatggcgtgaccttgattatagggagagaaagcgtatggctttgcttgggataggagagttgcctgtacagctgatcgttcgacttccgctaaccgacgtccctccagctctatatctggggcatgttcgttgttctttcgtggtgtcataggcagttgttcacttgtctggggatgatggggttggaagaacagctttggcatctggcgaagataaagattgacagagacacttctgaagccggggtgttcgatcctgattcatggatatggaaaattggaagctttacgaagcctagggagactgaatggcgagatgaggtcattggactgtgcttctgttgcctatacactctattgcttacaccagaatgtaagcagcgtatcgacaagctggttagagatttcggaaactccgaaggcaaagccaggcagggtcaagatgactctgaagacgaagaatacttcgaggaagattcactgtcagatgaagagctatacaggacgatcaagcaagctgttgaggtagatgattgggtaggaccaattaaggctcatattgagctctgggagagagggcagaaacggggaactatgttagaaagttgtctggcctgtggaataatttgatttatgaagctcttctggctgacaattgtagtaggtgatacctcaaagcactaattccgtgtctcctgtgctcaaggcaactgatttggtaccgcccgaatgctggcatgacttttccagcttcgatccttctcgtcaagcgcgactagcatctttccttgcacaatatcagaggtgctcctgtagccaagacatcatattgcatattgccatcatgtgcgttcactccgacttcacacatctccttatgaacttcttcggatacacggtatcgactatatcaaagtggccacctacaaaacgtagctctggtgtaagtattttccttaatcttctatccttttttccctgttggtcagaggaccagttgggaaggctcccatgagactctcttaggccaccaagtcactcagtcaaactatattgtagttccctactggattgcttgcaagatgctgcgggttaccgaattggtcgtcatgatacttgagtacctaaagctcaataaagttgcacagtttggacgagtttttgagccactgctatccccctccatgcagcaagagattgtgtattgctctcatcctctttgccactttcctgtgacttactcataggccaggccactgatcgctgagggctaccacatcttcctactcagaaaaggagcaaagatcctgatggaggacctccaagacttcagcaattgttgtcctcctaagtttggaaaaccgggtttcaacaacttccatcccatttgagtgtcagcgctctcttgaaccactatagcaggcacgcatattacccaaggcggtcatgctgcccttcccgatgtccaggctcgctaccactggccgcctctccccaagcctgtgaccatcggagacactctagtcaatagacatccatgaattcggctctcattggcaagtcttggatgatgatggctgtcacattgtcttacatgaatgtgatgcaaatgtcgaccatatctcaggctaccttgcacgccctcctaaaggctttataccaccacaagccagaattggttttgttgattcaacaatgctggtaatctcgacgatcttggaagatttctttcggcggggaagaagaaacttgccttctatagagcttggccatatctgccccagactgaggtgaacctgtattcgtttcttactcgatgagatatgcatgatattctgcagggttgtttcttgatgcttttggtatatgcttactctgcgggattatatttatattatgacaatctcaacgacgtctaaaaatttaaaaaataaatagcatgaaacttggcttctggtttcttttctatcgatcagtttcgaatagtccagcacatttgtcagcaagcatgaatttaacccgattacccactcgtcccactttttggtttggttgatatgacgacagcattatattctccggaggggcacccatcaacgggatatattctctgctgacatttcttttctatagtcactagaaatatttaattcatagtataatatatatccatgccaggctccaagctgggcatcttccccgccgcgggcggcctgggcggcagcacgatcaagcatctgctgccgcgcatccccgccgccaatctcgtcctcatcgcccgctatcccgacaagctggctgccgagagcgcagccggcgctgtcgtgcgcagagccgactacgacgacgaggcctcgctgcagcgtgtgtttgacggcattggcgcgctgtttttgatctcgtacgcgtcctgcgagtatgagcatcgcgcggaggtaagcagataacatattcagagataatattgacgaaaggctgactttttttcaggctcaccgacgcgctatcgacgccgcccttcgcagcggcgtcaagcacatcttctactcctcgctcgccttcgccggaaacctgacgaaagagactgtcgccctggtcatgcgggcccacctcgcgacggaggcctatctcgaagagctcgctcgtcagcgacgggacttcacctacaccgcgatccgcgaggggctgtaccacgagtcgttccccatctacacggccttcttcgacccgctgaaccccgtcgacgagatcaagatcccgcatgatggctctggacccggagttgcgtgggccaagcgcgaggagctcggcgaggcgacggccaagctgattgcgcagtacgcgacgaatccgcaggccttcccgtacatgaacaagacaatcctgctgtccggacccaaggtgttgacgctgaaggaagtggtcgacattctgggccggctcatcggcaagcaggtgcgtatcaagcaggtgtcggtggacgagtacgccgcgcagccgcagattgcgccgcgtctcacgtatcacggcgtcaacctggccaaggagtgggcgacggcgtgggatgccatccgccgcggcgagtgtgcggttgtgacgccgcatctgcgtgagatattgggtcgagagccggaggattttgagacgacggtgcgccggctgattgggggataagacagtatctgttggactcaagtatagatatcatttagcattcaaactctgcaagttcagcatgagctcaagagacgagtttcagtctgtgataccaatgcaataaatacacttcttgacataatgaagtgaaggcagtgactgtagttggatggtaactgtacgtgagaaattatacctagtaagaataacaaactgtagtactaagagagactgtaggactcgctatcagatataatgcgattcacctatattacaggattgtttttttttttagaggaaaaaggaaagtcatcttctttaaataagactttctatcctcaagtctgtctcgtttgctcgatttctattcgtgagtagtctaagagaatatacatatatattgggaatcagctaggctattctgtcaatacgatgagctacggttgataaatcagcctccggagtagccatttattttcttgcatggatgtcatggttattcaactgtgctccctatattatatatatgctaaaaccgggtactgcgaagcgtacataggtccatgtttacacgcgactttcttccaactcagcttctgacaggttgtatgcagcatacgtattcaacaatgaagaccgtattcctgccgattttccgtgtatacttgctattactccatactgttgtccccgcataccccgctcgccagctgatcgacggtgtttctaccccggacaggtactgatcagatccaatcagaacgcatgctagtcagatttattcatttctggcataagcatacaggataagcacagctggaatgtctagttccagctctaatggcttaattttccaccaatttttggcagtactctattgactctgctcgatatatatatatacagatcaacggactatctgtcttagttttgcagtttactgagaataaaggtgtaggatatttttttctggcaagatgctcctcccacccattgctgtgttatttgcaacgcgcgcgctggcagacaccgtcacccttcctgtcgccgtatcgcctccagcgtcagcaagcactccggttccgggagactttcagtcgttttcgatcgaattcgcgtttttccctgattttgctggtaggacctgtttgaggctgcttggtgaatattatataatttcgattttataggaaactattcccatcccaaccatctgacgaatactcttctggccaatctgcggaattttactggtgcagagcagattattcgtattggcgggaatacacagtaggaatcttctttccttttttttttgaatttatttattcatttttatttttatcttttatttttttatttttttgttgctgacctgcagattgccagagaccacgtcgtctacatcgcctcccagaaacaaggcatcatgaacacctgggactacacgtacaacctcgaccagcccaaaaacagcaccatcggccccgccttctgggaatcgctgaacgtcctgcaagacacaaagtacatcttcgggctgaacttctacaaaaacgactcggacttcctcgccaacctgcagtacgaggtcaatcagaccctgctccggctgcccagtgacagactgcatctgttcgagctgggcaatgagaacgattacggtgcgaattcggggtttcgtccgcgtaactggacgcagttcgattatgtcgatgagtggattttccggactcgtcacgtccagacgccccagcgcagtctgcgcttctttgcgccgtcgttctgctgcttcaatatcacagctccgacgttcttctcgccctggaccgtgtggaatgagtcgtatcgatatgaccgcgatgggtggatcgaggaagtgtctcagcatgggtatatatactagcttcaataatttgaggttttaaatgtcttcgtcgtagctaattcttactttataggtatatctcgtcgacgtcgagaaatccaactctgcaaggtgcgtctaactgtctactctgctagtacagctgacagtctcaggaacattgatgaaccatacctctgtcgtccaagccgtccagccacacgtcgagctgaacatcttccaccagcagcacggacgacggtacacaatcggcgagacgaacagcgtctcgggacagggctcgcacggggtatccgacgtgtttggctctgcgttgtggctggtcgattactgtctgtacatcgcgtcgcaggtgcgactccttaccatcgtggctcagttattctgacttggtatactgactgcctagaacatcacgagaatccacctccaccaaggcacgctaccgatacggcatcctggctgcccatccccgtcaacggcacagggccgctcgtcaagccgccgtactatggcaacatcttcgtggcgaaattcctaggctggtcaggcccgcagatcagcaacattgacttaggcagcgactactactcggcatacgcggcgtacgagggaggaaagctggcccgcctggcgattctgaatctgcaccagtacgaccccggcatgaacgggacgcagcggccacagacgagcttcgtccttcccaacctgccagattttacagcagcaaaggttgaggtcctcacggcgccgggcgcatcgtccaactcgtccatcaccgtcgccggtctgagctacgattaccagctgggtcaggggcggggtgtccaggtggccgcgacggggaccaccatcgagtcgcggaatgggtcgtttactgtcgatgtggcggcgtcggaggcggttattgtgtcgtttctacagtagatagtagcgtacttcgacattggcatggtaatacaatgcagaatataactcagttgttaggtgagatgctgtcctcatatctcgccagtattctacatatgccattgtctgtattcttctatatacgccattgtcttctatacatagcactaccggttaatattttttggtaactgtactgtaccgtattactttatcgcgcagtagtcgatgctacagttcttctatgtattccccgtattatcgaatgaaagtagcttgaagaaagcaaaaaagcaaatatagcaattttctctctctctctcttcttttttttaaataaaaaaagaaaaagaatgaattctactaggtaagagattaattcctgtgtaacagccacccacgtatttctgtagagtacactacatacctttattctaagtagtaccaggacatgcacatatcctctaaggacattaagtcctcgtctcaccgtacagcaaatatacgagcttcagctatgataatacgaatctcgtattccagggtccacggctgacatgcgccacccgtactgcgtgtaagcactctatccatttataaatacgaagttacattgataaaatacgataggcataggccagagatccagtaccactatctacctatcaccgtatatacatacctaggtaatgagacagcaaaagcataagccagaggaggacagagtagtgtatgatatttacagagtaaagtccctcgtggagaaatatggcaattcagagaaaggacatagtagtgaggtggttaagggcgagctttatcgccatccgggggccaaactcgtattgctcgaccccgcaagtcttggattctcgtccgtgcggtggatccgatgaggttatttatggcaataaacggcccccgcaagcagtcaaactgaggcacagcagtcaaaatattatcatgactggcagtctgtactcgtgacaggttactttattattcgttgtttgtctgcaggaggtgttattgctgcatgtgtcggctgttagcagaatcctcgagattgcgatctccactgtatcccgtttctagaacggtggcagtggggcgatggaacctcgttctctcctcgccatatctgtatggagtcatggagtacagacagagtcggattgagaccaatcagcagttctatatgctgctctcttatctttgagttctgattcagctgacttgtctgtctactccgtatttctgtggagctgcttgttaatatcgtctcgccaagtcgcaccagaagatcgagagatcgacagagtaacagacagttcaggcttcagcccctgcccatcacgccaaggatcctcatggcgcacgatgacacgccgttagtcgtccgtgcggaggagtatttagagtgagcctgctccagccatctccatcgaccgtctctcaccacacacccctccaccaccatgattctctccagcctgctgtcgctggcggctctgtcgctgctggcctcgtctgccgccggtgaggtgctcgagaggcttcgcgcgacgccgtcaggctggcgattctcgcgcgctgcccgcgacgaccagcccatccgcctgcagatcgcgctgcagcagcacgacgtcgacgccttcgagcaggccgtgctcgacatgtcgacgcctggccatccgcgctacggccggcacttccagtcgcacgacgagatgaagcgcctgctgctgccgtccgacgaggccgtcgacgctgtcgtcgcctggctgcagcgcgccggcgtccgcgatatcgagcaggacgccgactggatcaacttccgcacgactgtcggcgtcgccaacagactgctcgacacgcagttcggctggtatgtcagcgacgagacgcatgttcgccgcctgcgcaccctcgagtactccgtgcccgacgaactggcccagcacatctacatgatccagccgaccacgcgcttcggccacgtccgcccggagcgcaagaactcgcatcccaaacccctgcctggagaggcccatcgcgcgctgaaggcggctcgtctgggcgcgggcttcaacgagtcgctcgcctgccaggagatcgtcacgccgtcgtgcctcaagaacctctaccacatcggcaactactctgccaacccgcacagtggcagcaaggtcgccttcgcgagctacctggacgagtacgcgcgctacgccgacctggccctcttccagggctatctggcgccgtgggcccagggccagaacttctccgtcgtgcagttcaacggcggccgcaacgaccagaactcgtccgccgacagcagcgaggccaacctcgacctgcagtacatcctgagcctgagctcgccgcttcctgtcaccgagtactcgaccggcggcctgggctatcttgtcccggacatcaacgagcccaccgccgccgacaaccagaacgagccgtacctgaacttcctgcaggacatcctcaagctgccgcagaaggacctgccgcaggttatcttgacctcgtacggcgaagacgagcaggtaggatggccgactagttgacgagcgatgtttcccttgctaacgactgtccacagagcgttcccgaacgctacgcccgcaccgtgtgcaacctgtttgcgcagctgggcagccgcggcgtgacggtgcttttctcgtccggcgactcgggcgtgggcacaggctgcgtgtccaacgacggcaagaaccagacgcaattcctgccgcagttcccggcgtcgtgtccgtgggtgacgtccgtgggcgcgacgcagggccagcaggagagggcagcgaccttctcgtccggaggcttctcgaacctgtggccgcggccagactaccagaaggacgctgtcgacgcgtatctggccaaactgggcgaccagtggaagggtctgtacaacgagtccggccgcggattcccggacgtcgccgcgcagggcgtcaactacgccgtatacgacaagggcatgctgacgatgctggagggcacgtcggccgcgtcgccgacatttgcggccatcgtggcgctgctgaacgacgcccggctgcgcgcgggccagccggtactgggcttcctgaacccgctgatctacagcaagggctacaaggcgctgaacgacattactcacggcggcagcgacggctgcaatggacagagccgcttcgggggcggcacgctcgagggcggcgccgtcattccgggggcgagctggaacgcgactgagggatgggatccggtgacggggtacggtacgccggattttgcgaagctgctgaagctggtggtgcagtccaaaaggtagccaaacaactcgcagtggtgctattcgtgtaacataccttgtctgcttgttgtttttcgtatatagctagacggatagattgaactagcatgtatctatctcactaatactagagtcaagaccatgactatgataatctaggccgtatctctgataaatctggtgagagagtctacagtacctgcttagggagtttcagcattgcattttaaatcagtcgtacatacagcaggtagtttactgcaaaatgtaaatatatcttgttttcccaagctgtcgaccagactggaccgttctataggcaaagatgcatcttatgttagtataaatacttcaaccttaggtatacttaacttgtaaccagaatattcagaatcaacagctcgtgggaacgatatcgaacaaaacagacgactcgcctatccaattctatttcagtagatgagagtagtccatatatataagtacgatacaagaaacgaacacatttagttttaaacaactgtataaataaataaatcttccctgcctgttattttttttttagaaaaaaaaaaattcaactgtactggcgaaagcagcttcattgataaatgaatattctaatattctaattattagacagaccacggcaagagtcattaaatactgaccatgagaggattatattatagtagtactatcgaggatacattatacttatttttttattccggatcggggccttcaagaatatatctctggatggcccagtcgtgaactgcccagagaacttgtacagtctcggcattttaaatgggcttaaccaacaggaattgaagttgaaggatgagatattagatcaattcgtgttttgccaggcgattcgggaagcggatggggttcggattgctcttgatcagcaactgtcgtcggcgactgtccgataccggatgaaacggggaggtgaaatcacgggctttgaacaggtcacgaagccgtactgccttcgatacaagaaggcgtgctattctaggtaatgatacccttttatctgtacaagaaggccaaaatcgcattcagcagcttgatacgcagcttaatgagaagcttgatgagcctacacctatgcctcaacggcgagctccacaacgctgcagtggctgtgggactattggacataccataaggaattgtcctaataaatagctatatattcaactactagatagtctaatttaattgtattggtggttgaaaagcttcaaaattatagtgggtgcggcgaaaattcgtcgctcggtggtattcgtcgctcggtggttgattacgttaatctatttaatagttaataatttatataatattaattaagtaataagtttaaagctataagccataaaaataaggtatagaagatattatagattcctaatagagtattaagataataaatataagatctaatcttaatactaatatatttagtattctttatattaagttttttagacttttagtaaatttatatatgtattttaaaaagagagctagactattattaatataatattataatataatattataaaaataatttattatgtctttttaagcttattatataattattattaaagctttaataaggtctaaaatattatagttttatattataacctttattaaataaggctttaagggttaataattttaaaggttctttaaaaaagtttaatagctttaaacgatatttataattaaaaaaagcttatctttattaaggtaatgttataattatttaatactaatattattattaaatatagctatacctgattattttattaaaaaatataatagaatattataaattataacctatagtttaatattattagtttaataatatccttattaagctagttaataataattataattaatatatataccttaatttaataattttctaataaaattaatatttattatttataattagggataaataatagttttaagagttttttataatataataattagctattattaattttatattctaatagagagactttaactcttaaaatataaaagatgttttttaaatataatagccttctttagtttttataaaatattattagcttcttaattttattaatctttaagtaataataagtctttatgtagtctcaaaaaagcttttataagacctttttctttttttatataaattcttaaagatctttataaaagttttctctaactctcttagcctttttaaaaaaactataatataaaaatataggctatataaataaatatataattcccttttcttcaataatataagcctaattagctactttttatagtattagatatagttatctataatattagtaaataggtcttatttataataaggtatctattttagtattttaaaaataagcctaactagtaaataataataaaattaaactagtttaagaggttagcttattatatctattactttataaggtattaaaggcttatagaatattataagttcttataattagagataaatattttttaatatatttttaagcttagcctcttattcttataagtaatatataataataaaaagttcttatcctaaccctttataaaagaccttaaactttatataaagaagactaacttacgtattattaatctattattagtaatcaaagaatctaaggacctaataatatccttctagaaggtcttagctagataaatcttagataatagtaatataatcctaactatagatttgcttaaggatatagaatagcttattaagttaagtatataagttaaggcctttaggtaaaaggctgcccttaagatccagaggtttagtattgtaatatatagggttaatataaagatagatgtatctaattagtaggccttaactaataagattttagtagtaaactattagagactagtagctatacctactaattattatagaccaacaaaatgggacgctgtccaacacagcgatgcaggatgaaacaataccccgcaagacagaaacaaggatctaaagatcatgtgactaagacatgtgcatataccatgggaaggaccataagccgagaaagaatggtatactagatggtatataaataccagcagggagaccaagggagagacaaagatggtatatggaaaggtatacagaatagtatgaccaggaaggaacataaaagggcattatttctgctcatgtacctagtcatcttactttgtgctcaatattataatcagttactaagatacttacttggagggtcagtagtctgacatcttactactattggtataccttatggtatagctctagtaggagttgccctgacctagtcacttgtgtttcattattactcaaagacctcaattacttatctatcagttactacttggagttgatcactgtgtgagatcctggtctggatctgtgaaccttcctaaccaccaaagttgagtatctgtgacttaggtcagcccagcgtgtaacactaatattatttaggtaggctagctcctaggtattattattattatcacctaagcaataggacttagtagctaaagtctaaatacaggtggattgtgccatagtccagtcgtaccccctcccggcgggtagtggtatccttccatgaggcgctgattggttgtccctgattggctggttggttggttgggggtgctagtgtccctgcttacacaagcgcccaggcaagttgtatggtaaatgtagaataggcctatactgattataacgtatttcccggctgtttcgatcacccggttgctccgatcactagaatacccatacaaaatgcgtttttttgtacgctcataccacaatgtctatattatatcctggcctttaatcttaaaatcagattatatataggtataactacttgtaagagaaatataaggttaatattatatatattgctttttagatacctattttttaattttacataaaaattacactgtattttactgatctgcaatgcaataacgtatttcccggctgtttcgatcacccggttgctccgatcactagaatacccacacaaaatgcgttttttgtacgctcataccacaatgtctatattatatcctggcctttaattttaaaatcatattatatataggtataactacttgtaagagaaatataaggttaatattatatatattgctttttagatacctattttttaattttacataaaaattacactgtattttatattattccagtaaataatagagtaaacttattattattaatcaagtttaatgtccataccgagcctttcggctatgacagaccccgaatcatgggccacagcccctatccagtctctgaactcatctttgaccattctagacattttcctcgccccaaaccaccttactgtgcagggcctttgggcattaagtatgccctccttggtgttatcaccgtatgggtgttacctgcctgctacaggccaccccccctgttatccctccccttctcgttctgcctcttccaggacctccagcccccattcatcatccttatgggccctatttactgcccgtgcctggtcccaccgtgggcaacctatggcagtgtctgctaggaactgtagcagggctcatgaggctttagggttcccaaacagccttccttctggatacttcccgaacgaagacatccatagggccagagacgtcgacccggacacgttcatgtccctagatgaattctcccgctttcgcgaatttgtcagcgaggatctgcacagcctctacctgtcgcttatgagcacgccgccgccagaggacattcatctaacgcgggaggtgcggcacgccctggaccagctcaaattgacgacaggcaagatcggcaccgcaaagaagatgatgactagcacgacgaagtgggttttgcagatgtacgcgggggaaatgttcgagcgatgcggcgggctgagtctcgtcgagaagaggtacttgcccacgggggtgttggccatgatgcgcgggaagaaggttacgtggcagatggttctgtaaatcctaatgcatgtacatacatatgtccagtatagatatatctgtatggtgatacattatagttgcgttgaaatatgaaatccagggattcaagaaagaaagaaagaaagaaagaagttggactagaagtggtgtctatataaggcagcaaaattaatattttatttatgtgcaaacgctaattttaccttttggctacaataatatagagcttttaattttggccaggaaatagttacgttagtaacttagtcagcctaaccgcgtgacaaggggcgtagttagtcaagaagtcaagaagacaccttttgcaaagttctgcatcaattctcgccctgtgatcgactcggaaagcgcgctacagtctatccctagtcttgttgtcccgtgaaggtttgcatgacatggcgagtttcgaagattactattgcagcactttggatagcatattccctcccgtgatacaaagttgggtgctctgtttcccgtgcgatacaagcaaaaaacatatcatttccaacattctgcagaccggttttgcgcaaaccatccaccaaaaaccatacctcgctggtcgactgagcagagaagataccggtccaagagctggcagactcaagcttacttactattacccaaatgaaaacaagcccgtcgtggacacgcagcttttttgggtaaacgacctgacagaaagacaggacgtttggcatctttcatatgaagagctgcgcagacaagagatgcccgtcgtccagcttaagcctgagatactcgaacctccccttgggtacgaaaagttggcgtcattgctgatcgccgcccaggtcaatttcattcctggtggatgtctactcagcatctgtctcaatcatgcgttcttcgacggcgctggtggggccatggtcgtgggcgcctgggcccagaattgcaaagagctccagcagcagcatacagaattgaccgcagtttcagaagctgaacaatgggagaagatgcctctggttcattggaaccagtgcgaaaacgcgacagccttcctatcgcttcgcctccctgatatactgcaggacagcacagctcctgaagatggagaagcaaagaggattctgcaggatcgctcgctgtggcagcttcttgggcttcaaaagcctcccacagaccctcctaccgcgtcacggggcttaccaccttcgagtagtaagattatggtctctgcgatcttcactgcttccgaaagatcgatcgcccgtctcaaggcagcctcgagcccatacgatggcgatgaaggagctgcgccttatgtatcttcctttgatgccacagctgcattgctctggaggtgcatcatgagggcgaggctctcggacattagggaatcggacaagacacgttgttcacgtcttcgcatcccggtgaatctgcgacagacgctggaaatttcccatgactaccctggaaatgtgctcctaaacagtgtcaccgagatgccgatcgaatctctcgttgcagaagctaatggacgccgggtcgcacccaagattcgctcgtcgctgctctttagcagagacgctggacgcgcgctggacgctatcaagctctccttcgttcttcctgagttcggatcccgtcgtccgctcttttcggacacgacacgacaggacctggttctgacttcgtggcaagacttgccgtattacaagcatgattggggtcccatgtttggatctcccggcacggcagagttcttccggatccctcacggctacctcagaggcatatgcgcgttgcagcccagacggatcgataataatgcggtcgaggttctggtcaatttggagaagggccagatggacaagctgatcaacgatggtgagttcacaaggtactttgaactcaaggctctatagataggaggaagtcgcatgtcgccttgcatgagctagctagcatgtatctgtctcattcctaatgaatgtttctctctctttttcttttgttttcccaataaattgagcacaagcacatgacattaagtccaacattcctgagaaggcaagttgagccgtaattaattaatggcacaatccatctatggataacgtatcccaggggtcattcgcgcacccgcatcaaaacgcgtgtctaaccttaaaaaaaaaaaaaacagtaattatatgcagtacaagacaaaaaaaattattttctgataaaactagaatatgactgattgtatggcagttgtagcacttcagtaacgcgcatatgaatgaatggttatgtaagatgttggcataatatctcagactgtactgaggacagagaagcgatgcagcatgacatgagttgttcgtttccagtcatcatcacatctatcgatatgcggttagctacgtgtatgtaaataaaatcaatcggatgatccatcaggggaaaaaagaaagatcgataattaaattaagcccacacattgggttaaaaaactatgttgaaagagggaacattatgcgagtatcaattagttcccaggttaaaaaaaaaagggtcgaccaacttggtaaaaaagaattgtttatggtgattccaaacttccaagacagattattcaactgggtaagtgaaacgagacacgggtgaattgagtttacttttttctttttcgaccgcattctcagtactagtggcattgtcgcattgtgaaaccagagatatagagaattatataaactagcgctattcaccatgcgcatactgtatttggaggaattgtctgaggtggaagcaggaaacagcgactctttctagtgatatcggaatataatttaggactaaatataaagagtgataaaaaaaccaaaataaccagcaaagattgaacacttggatgctccagaaaatgagctcgtggaaataattcgcaaaggtctgtcgactatttcgtcattctagagtgaatatctcgtacaacatagatttgtccatagaggtcggtgacattgatgaagacctgaacggctttccaagtctgcgggtcaacctccggcttcaatttctgcaccgcaagatcgagacactcccgctcgtaactggcgatttggagcagggtttgccgaatctcatctgccagttttgtcgattcggaagaagaatcagtctgtagcccattggggtagccattcttgctcccgtcttcttcctgctcatgaaattcaggaaagttggcactgttgagattgttttctgcgcggtcgcgcgcgatggacccgtaatcgttatactgtcgacacatagtggccagatggcggcagacatcttgggcgagatatcgcgaaagggcaccggagaaacaatctcctccagatggagcaatcaaacagcgaaagaattcgaaggaataagggcagctcgtgtgatccgcagatgtagtgcgcacccagtcgtagtaggtacccctggcgctggtgaagaccgctaacttctctggcgaggccggcttacgcagtctggtgttatcctcgccgtgggtgacatgggcctgaagaaaaatcgacagttcctgtctgatgcggcggtgtacgacctcggaagagccagaaaccttggggtgattcaacacatacgagataaagcgatagagagtctgctccacttcgaggaggaacttggattggtgtgtctcgctctgagcgatagtgtggctcgggtggccattctccatatcttgaccatgactatcaaaaagtcggcggataacggccctaagagctccgaaatttcccttcaaatccgggtgctctgtggcttgctcgagatattcgtcggcttgaaagttgagcattgagagtaccatcatatcacacatggtctgcgttgatatgccaaagtccgttgcattgttgcacagcgtccatgtaaaaggaatgtactcccggtacttgtcaccgctcctgtcctttctcggaaagatatcaggctgggtctgatggagtaaaggtgcgaacagatatccttccacgatagaagctcgcagcttccattttggctgctgcgaaaagattggcagttttgaaaagaattgggaaaacttgtcaactgcttttgtatcgatcttccacagatttaagacattctcgccccagttgtaggcactggaagcttgcagcgctgccagacaatatgtctctgagaggatcccagatccgtagctgaccttctccacccagatgaatcccggcctattccattttgtttcgttggcttcaaggaatctagttccacggaggatactatcatttactgttgcttcaagggtcttcgtccaaggtagcgaagcaagttttttcaaggtcaacagtgcataggctgtaatctccggcgagcctttccacgagccttgctcggattgcgcactgagggttcgcacaagaatctggaaggtcaccagcggaatgcggtgtgcaatcagatccggtggaagatcagctaaggctccagtatcccatagttttacgacctgtgtcaggctccctgccaggagcaacatcgaatattgacgttccaaattctgtcgcgcagtcagtagatacatacaggtgcccgcatggcgctcttacccatttatcgttcaactctccgtggtaccatgtctggcagagaaaatcgagcgcttttgaaagctgagagagatggttcgaggggtttttagactgaagaatggctgtaagaacattgcaattggcactgaacgactctgttgtctcgaaatcgtatgttttgaagtgagtctgagcctcgaatgactcgatcatcttttcacaccctgtgggccggcctaagagattgagcgacaagatagcttttgcggtatcatctgcgtctggaagaattccaggggcttccagaggatcagcagaacacttctgaatattccactcggaggaagttaacgcaccaaaaccagtgattcctgcattgttccgtaattgggtctccaggaagtctgcaattgtggcaacattattctttccaaggagatcaacggtgaagccggactcgagcagcgtcgagagaacctgttaccaaacaaatcagaaaccctagtttccagtcaacgagtgtattgcaattacccatgcgatctcaaacacgctaacagggaatgcgcttgggacacaacccttcccagcctcgacgacaaagcgcaggtaagcctccgcgtcaggattccagctcgaactgttcatcagatatgccgcggtggacgaaggcgaacccatcatggctccggagtggaggtggtgagcgaccttatcaaagtcaatctttccaataaaagcctccagcgagtgtaataatgtcgtcttatggggtgtataaagaatggctggggaaaacttggcgagtttttgttgattcattgccatcaggaccttgaaacccgggaactgaaaatctaatccttctgcgagcagcatgtccaacagattgggaacaaggatctcaaacccaacatgtaccgtcgaccgtacatcccagcgctgcaatttctgttccaagaagcggcgccctcgagcaattctgcttgccaagtcaggcactgatgggcacccggtcaccgatgggttcttttcatgcttgcagagggctaatagggctgccattgtgttcaagatttcatctacctctgcgctctgcgcgccaaatcctccttccggagactggctctctagaattgattgaaagcattctgggaacagccagcgtgtttctccgtcatgcttcgtactggtcgacaccatagccagccaggcggtatcatagacagttggggtcatggagctggatccatgatatggcgtgtccaacgatgtcaccagatactcgacgatttgccgagctctgtcattcacagtagacagcatcctgtcaaccgaagtcaaaacgagtatcaattagaaacttgcagtgacaggtagggatggcaaacaatggagatcgcaaaggcataaacaatgtggtcagtatgatatacagatgtagatgttactgaccaacaaaaccacagagcaacgtagaaatgccgcacagcatgagacaaccccgcagggacaaggaaataagaccgatgcgtgtcggggcactttcgtctccgggaaaggataaagacgaatacggcagtcgtctagtgaagcgtctaggaggaaattggcaagactgacaagaggatgacggaattcctagggaaaaggggcgttccttatccatcatgtatccactcttactcgcgttcaataacgaacaattccttacttcctccgttgtctacttcgtcgaactcctcttggtacttggatagcttgagtgggcgtgccactgactcagttgttcttatctctagtgagtctataccgtgggaaacccttagaaagcctcatcgacaggttgatctacggggaacagtcccgggaagtgtgatcacttcatcacaataatccttcgaaacgaccaacgcaggaggcaatgcacaactattgccaatagattcgatcattagagatcctaaagctgctattactgattttgccaaggtctgtagggacctcatcggccccgaaatcatcatctgtcagtgggcatacacagatatactccgcatgtacacacatgtgcccaaaatttggtatcggacaggggtatggaaagagaattttggggaagacgttgatatccgctgcagccgcacgaagctgataacgaaactgagaatgttattcagctagtcagtttttactaatcgaaaaaaaaaagcaaacacgatataccgacgtgcctccacatgtagaattgagaataatgcttcaatacccccgcatactgttagcccgtttcgttgtatcaagctaataattaggcggtttacaggatcaatatccatgaatgtgcatacatacgggcgcttaatttctcggttacccccctgtcgccctaaaattttcgcccccaaacaaacgtcttgcctttttggaataatccagtgatttttacggtaatgcattgttttggcttgattctcaaatcacatacggcgacatacacgccagctactgggctaggtcgaaagtttccacctcacccgttcaaagcaactaccggggtcgctggaggtgggggaaacctgattgcacaacgatctgcgactgggacaacgatcctcgcagctggacctttgcaggcaaagggaattggccaaacgccacggggactaaccagcagccgttatgatcattacggactggacggcagtggcttttggcacaagaggccgatactctgtcaggatgagcagggaaatatttactgtgaagattgacaggatgaggattttttttttcccccattctgccaattttctcacgaatgctgacggatggtcgtctgtttgattcaacatggataccctgaactataccacaactcctttagaagcaccggtcattgtgcctaccactgtacattctcaccccgccttcaagatcttcgcagttttagtgattgcctctttgattcggtgcctggcattcggtgcagagggaaacgcccaagtccacgctcccatcgtgggtccgaaggactcgatccgggcaagatggcagttttttcgaaatgcatcaagacttgtgaatgaggggtatgacaaggtaggaacttcactcggttgcttggtacaaatattaacgatgggtagtacaagaataggatcttcaaattgtcgggacacgacatcctggtcatcccaaataaatatgtagccgagctgaagaacatgcctgatgagcagctgagctcaattcaggcaaacatcgacgtatgggatcgaaggtatccggagtcatggcctactgctgacggctgcagaacttcgaaggcctctactccaccacctccatcctcctggaagggaacttgcatactcgtacgattcaagcccggttaacgcctagacttcgtcaccatgttccggtggttcaagaggtattgggaagagcttttccgaaggagcttccggcgaccaaaggttagtcagttttattcaacatctacttgttctcttctgaccgtggagtggtagatggctataccagcgttaaggctttccatctagtcctccgtctcgtctcgttcattgcagcccgacactttgtcggcccgtcgctgtgtgaagatgaggaatggctgtcgaccgctctcacctataccgagaatgcattcaaaacgatcattattctgcgaatcttccccgactgggccaagcccgtcgtttctcttcttattcccttttcatacaaggtcacctgggctttgaagaaggctcaacgcattattgttcctctgattctaaagcgacgcgaggcggagaagaacaatcccaactacgagaagccagaagatttcctgcagtacatgatggacggcgccaacgagttcgatggacggcctgataagctcgctcatcgtctgctgattttaactcttgcagctgttcacactacgtctatggctgcgacacagacgttgtttgacttgtgcgctcatccggagtacatcgagccactgagacaggaggtgatagaggtgctggagagagagggtggctacaaaaaacaaaccttaacgcatttccagaaattggacagctttatgcgagagtcgcagcgactgaatccgcctagtttacgtatgatttccacctggcaatgaaagaaagaggcccaagctaaaactgcttccttagttggattcaaacgcgccgtccgccaacccttgacgctgtcggatggtgtctatctgccaaagggggtgcatctgatgatgcccgtctacccgattgtcgtcgaccctgaagtcactccagatccttatacattcgacggattccgacatttgcgcaatcgcgagcgaccgggagagagcacccgacaccagtttgcaacgacgagcgacaataacctgcatttcggacacggcaagtattcatgtccgggacggtttctagccggaaactcaatcaagatgattctctcgaatatattactacggtatgactttaggtttcccggaggttcgacggagagaccacgtaacgtgcatttgcatgaatacgtgtttccggatccggaggcccaaatcgagtttaaactaagagaggagaaatctcagtggattctttgattagaacatttcgtattagaatagattaggaatatctctcttcttaaactcccccgatcatgcatattcgcgagtttcaagcatataaaatctatataacctagttaatataacccagttatccggtcatattgcatacaatcatcctgcgatcaataccgcttaggacccctaggtatgtgactgaccaagcagataaatattaatcctcggccttcgcaaattgcttaaactggaaacattacccgactagaaaacagagcaattggaaagataatcatatagaaagcgccccggtacgccagtataggtatctatgcaactgcatcaaaagtattttgaggcttgctccgcccttgcccatgcgctttttctatttagctaacaagaataagagcaactgcggattcattgtctcagctgagcaggcctcctctggagtgatctacagattattattattattattataatcaagtttaacgtccatagcgagcctttcggctatgacagaccccgattcttgggcagaagcccccattagtccctaatcccgtctttgaccattctgaaccttttcctcgccccaggccaccagcccccattcatcatccttccgaattctctcggctgcccgagctgcttcccctaaggggcatccaaccgtcgtgtctgctaggaactgcaggatggccttggggggccgtaggatctcctagtagccttccctctgggtgaccctcagccgttgttggcaaagccaccctagccttggttagggagtgatctacagatgcaacttgtcttagatacgcatacggatgtactgttctgtacatacatcatacttagcaggattgcgattactgtgttacatggcacgtcgtccatcattaataattaattgaaccaactgaaccaactttaccaacgctgatgctattggatcacatcctgccaaatatcatacggagtattagagactatcagccaacaaagtagtatgtacatacatgtaggctatattagcacctcataattactgcaacccacccctgttttttttttcggcaaaactgacttctgcctcccgcctccctagtaaaatctagtatttttggcagtaatattgctagtaattaaacttgaagttttttttttccctagaaaagcatatagaatatagtattaacgttacctagtcatgagactctgatttaaagctacttctacggagtatatagatggtcccttttagggcttacggggaatcgccctatggtatagggtagtcttcgagaaaaatgtattacttctgaaaattctaccccggtgtagattttgctagacaagacgcgaagtggagaggggaggagatgggggcaatagtcagttctgcaagaagaggggttggttgcagtgcttaagcgcctgcccctcggctaaacagatacatacatacatatgtcaatgctctatatataattttgcagcactagcgtcactctaaattgtgacagacgtgcatagataggtacacagaattctaattcgagtactccaatgaagaagcatcgacgtgtggatctgttacgtcgatggcatgcagactcttcttgacttcgagtcattaacacatgggtttgcaaaatacgacactgtggtaacccatgtggcttggacctttttctgaacaaggacaaatggcggcattaaatttgatgattgagagagacttctaatcctgtctgaataaaaacatttgtgtctccgacgatttagtctccaaacatgagacttgatcagagctctatattaaaaaaatcaagaaagaaaaatgggtttcacgcagacgttaatgcagctgctttttcgggagaatttcagcattgctatacagagcattcttgtcggcctcattaccacgtatgttctctcgagccttctttctcaccactacaacagggttaaggcacccagagttggaaagaacccatggatttcaggattggttcgcgcccgctcagactttgtcaggaatggcaaagacttgacgaaagaaggttacattcgatacaaggattccatgtactggatccagactggggacatggaacgtctggtgctttccaaccgctaccttgatgagctgcgaaaacttccagactcgcacatagacagcaaagcagctgtcgtcgaaagaaacttgggctggtacaaccgcgtcgacattatcctgaagagcacggcgcatgtggacgtctgtcgtacccagcttgttcagaaccttggtaaaaatcccggatcctatgccatcttggaggtcgttactgatatagcatagataaagtcattcagggacaaataagtgatcttgggaatatctttcgacgggagctggacgcatgcttccagaatgaaggttgtcgtacactggagcttactacaaagccaatatacatactgatctctcgccagacttccacttttacaacgccgctgcaacgattttgaacattgtcaacaggagcgctgcgaaatctcttgtcggcgagccgctttgtcatgacgacaaatggctgcgcacgagcttggagacaactgtaaatacgggcatgctgtgcagaaatttgcagaagtgccctgctattctaaggcctctgatatgccctttcacagcggcgcgcaagaatttggatcgtagttttgacgtcgcgcaagagttactgtcgggagtgatcaaggatcgacaacgcggcgacaaaaacgtcgatattctgcaatggctaatcgacagctacaagggagatgagctcagcattccgttcttaaccaatcagaccctcttcatagcaattgcatccactcgttccacagcgacgtcaatcgtcaacgccattttcgatctcatcgccttctcgcaataccaacagccacttcgtcaggagatagaagaggtcctgaccgaatctcgcggctggaatctgtctgcccttaaaaggatgaagagactcgatagctttatcaaagaatcccagaggctgaaccatcatatccttcgtaagttgtccaatacctctttctgcttggcacacacacacacagctgaccaacattagtctcattcaatcgcaaagtgcgacgtaaaattactctttcggatggcgtcacaatccccccaggcacattcatctgtactcccgggtactgggccgcccgagaccccgaaatcttcgcggatggagaggatttcaagccctggcggtggctcgaattgcgagaagcggccgaacgagaaggcaagagtgtcactccgtacctggccagcagcacaagcccggacaatcttcattgggggtatggccgaaacgcgtgtccggggcgcttcatggcggccgcggagatcaagctgattctcgcctggatcttgtggcattttgatatttcgttccccccgggccagagcgaaaggccggaaagcctgttcgtggacgagcgagtcattccgtgtcccacacaagagattggctttcgacgacgcaggacgtgaaagtcgtgaaacatctccaagccgaacgcgatttaatcgtactcgctgtgcttctgtggaatagtcacactaacccattaggttggcccaaaaaaatgcattaatttaacattattaagactccacaaatatagcttctttggtaaataataattactatagattataacgtaattcccggctgacccgatcactttcccgctgccgcaaattctatacacaatttgaacagcttcaacgcgtcactatgccaccaaaagcgcgtacaaattcaagaaatttagttgagcaagaagacagaatcttaatggctctttctgatatcaaaaaacgcgaaaatccaatatctatttgaaaggcattgcgtctatatgatattccttttactactttataaaacaaactacatagtgtcacgatgagggctgagaaacaatatcattaacataaattaacacaaactgaagaggatacacttgtacagtagattctatcaatagatcaaagaggcgcatctccttggccagcctctatataagagatggctaagattttggtttttgaacacctaggactagatacccaagtctctatagggaagaattaggtttctacctttattaattaatatgataagctaaaaacgcaatattcctgctagtataattattaacatgctaaatatgaggatctaaagcttattggcaagtagtttgaacatatatgaagcacaatttaataatatagcatcctcaaagaggatatttataattttgatgagaccagctttgctatgggcctaattgctacagccaaagtagtaacctaggcagaaatagcaggttatctagtcctcatatagcctaggaattgcaaataggtattagtcattaaagcagtcaattcaactagctgggccttactactatatattgtctttaaagctaagacttattaacaggcttagtataaggcaaatcctttgctaattaattagagaatcaagattagtcctaacagctagactactgataagattggcttattatggcttcaaaatctctttatactatatacaaatcctcatacaaagggcacttattggctactagtccttaatgggcatagtagctatcttacaccttaatttaattgtctttgtggccagaataaggttatattaatttgtatgctactgcatttatctcatcttctttaacctcttaatgttggttgttttttggttttggagcacttatatagacaaattattaaggagaacatgcagcttggaatcaaccatattaacaagctcaatttccttatagcatgtgacgattcaacttgcctgtcgtcacgtgagcggtgagaaaagcggtgaggtataggtacggcagaatacttgcataaatcgcctcgctagcgacctggctcccttccttcttctcctctcctcccagcctagtctcttgtaatttagatcgctcctagtgataagaaactgctctattgcctggaattggatccgtcacattagactaggctcaacccactcatttcttaccatttctactgcttctagatacggtctgacgcgtctactagaatacccatacaaaacgcgttttttgtacgctcatacctcaacaagctttaaagatattaaagagatattttatatactataattataaagtatttacagcatacagcattgattagaagtagtctactctattatttactggaataacataaaatacagtgtaatttttatgtaaaattaacaaatgggtatctaaaaaagcaatatacataatattaaccttatatttctcttacaagtagtcatacctatatataatctgattaaaattaaaggccaggatataatatagacattgtggtatgagcgtacaaaaaaacgcattttgtatgggtattctagtgaagtgtcttttttataataacctcaagctacttaacctcctataaaaagttaattatataggcttataatcttattaattttttaaactctagctctagttatttttttaatttattacctattataataatatattattagccttaatagtatatataatagggggtagagttacatattagataataaagaagtaaaaatatatattttcctactatataaaggaaaatatattttgctgcgtatttatataaaagttattgattttatgtgtatagcctcttagtgtcagatgtgttgtgatcttgtgatctacttaaatattttctataaatatcttatttacttctagtccctagctttactatcttccctcttactctatctatttattactctattattcttacctctattttcccctattatctctatatctattgttccttatttattatttcttatacctttatatatactttatatattattatatatatcttctagttatcttataaattccctctttattatttttagaaaatatataataatctacctaatataaaagctattaatttaatttactagtagtactattaaatcctttagatccctttagtaactcctttataacaataagatggtcctttatatggtaatataataggacttttactagtagtttaagctataataagtttattggttccttaatttattcctttttccttattaacctattatatactattctattactcctcttctttaagataggtatagttagcaattttacttcctttctctactaataatactactactaatagactatactatatatatagaagttagaatatattataaagtcctatcttaatttagtataaatataatagtttagctattaataattattttcttttatatctctttaggataggtatagttaataacttagtactaattaattatagttttttataaatctttctttctctttatataatacatagtagtcttatttttaggttttttttcttattagttctaagctttaataataattatattcattagtctaaaaatatatctctctttaaagctctttagtttcttttttattttctctaaatatcttgccttttacttattatattccttcttattaaacctaatatatatcctttatctccccagcctattttagatatttatagttattttaatctataatataggttactttataagttctgttactaataatatctattatttttacaattagctactccctctttagtcttagaataagttatattttatatatataataatacttaatatcggccttttataacttaatcatatctagattattactctcctatccctacctcttagatgtattgtaatatcttatatattatatatcttactattatagtaagtctaaataagccttttcagccctatagctctataaagactataactaccttatacctacttctttatactattcttaatatattaattattatatagtttattaaaataaagattcttataatactattctagcttctaagctatataaagattatagttaacctattagcctcttagtattattcttaatatacctattattatatagcctattaagatctagatataaattaccctattattactttaaggccttataagaatatagctagtttattctaatagatccttttaatattatatatattatactaactattatacttcttaatagagtttttattctaataacttaattccctttattaagaaatataataattatagaaaagaccctttttaaggtaagtattttactattattatacttactaaatcttttataattaattagtctaaatagcctataatattattttagtactcttagctttttatctatttattattaaaagctattaaagttaaggtaaataaagattaaatatcttttatatagtactctttattagatgactaagattatctttaaaaatagattaaatatttattagtttactatatattataataatagtagcttaataattaaagattaataataaacccttaagcctaagggtcttctttataaattatttattttatagatatccttaataaagagattctataaatatatttactaaattaatttatctttagcctatatatttagaggctattagataaataactaactagattattaataaagtacttatatattttgattttaaggtattatctattattttcaaggtctattagatagtaatatcctaatttatacttaattatacttccttaaccctaataagactctttaaatttagatttaaaattacttttccctttaataaataaagtctttaatctattcctatataagtagaatctctattattaaatattcatttaggcttataagatcttataataacattagactataaaagtttttataattaatcccctagttaaatcttatctctaatcctattaatagctaaacttataatctatttttagaaataggaagttataaactaataacttttattcttaaaattcctaataaataaagataattaaattactaaaatatttaattttatctatattaggctttaccttaatttatataggtaaataagctaataaataatgtttaggctattatattaataaaggattaaataatatctaatagtataatagttattatttaatatacatatactattagtatctattctacctacctctatattatatactctattatataataaaagatattagcttttaatataataatatttaaaagtcttacttaatatggtaaaccttatctatattttaattactatctaagcattttattattagtttctttatatatataatattctctctattataaggcctccttattttaatagtttattataagtatgtatttagctattaagataggctatttaaagtacttctaatttatattaaactctattaagacctttaggtataattataagatttagaggatcttaatactattaattacattattttttactatcttttataaaaaggtttactatatataataatattattaagattctatagtaattatttactactttacaaagataaccttaggatttataaaaataatcctttaagcctttaatagtttatctctctaatagatataacttattaaatagatattattataaataataatctttaagctattaattaatagaaaatacctcttaataaaattttttaaatattatatattaaatctagatatattaaaatatctcttaagattttttaattttttaaaatatataaaagtaagtcttttaattttttttaattttattagcttttaatatttaattatattaagtccttaagaggtaatagttcctttaataaaaacctttttactagattagttatatctatattattatactattttaaaaagaagtttactacctctaatacctctttattattatattattatatttagtccctctagttttaaagatctctaaataataaataatacaatatataatactttaaaggcttattatatttaaaggattattacttaagaaaataagtaggagctatactttaaaaggcctataaaatataaataggatagtatttataatagctattagtctttactataatatatagtagtcttattaatacttatattatctacaattagttttataataatatttataataacttaagtaatttataattagtctttaatatcctcttaacttataatacctagacttagattataacatattttatttagaaagacttataaaataaagactactaatttaaagactaaccttttttaatttattaataattaggcttattaaaatctagatactaatctctatattacttaggaactagcttataactaatctactttagaattaaccatttaataaaaggttttacttaataatactaatatatagcttataactaaaatttttaataaatatagaaaagctttactataatatagttcttcctttatagccttaggggtataaagaagactttcttttactagatactatataattacctataatctaaaaagaagattatactctatatcataactattagtataatagctttatttctttttaaaaatagaactacttataaataactaaagattcttgttaatattattaaatcttctatttatagtatcttatccttcttagattattataaataagctttgcttcataataattagtactaaatttaaattaaaataataattaaataaacttaattattaataaaactttatattaaggtttaatatatttttatctttaaaatatatttttagaagatatctaaattttttattacttctatagttatataataatataggattaaagttaggtcatctttaaaacccttaaatttatatataaattatatattttttaattacttaggatttaatgtttgagctatattttattaaatatagatttaaaataagtggttgattttgaggatacaattttaggaggggtggatggaaactaatgacctagtactgtaatctagagattaggtttattatattagactaagctcccttttatcttttttcttttaaagtagttagagataagccttatatattagtattactaacttatatagagccttttaatagcattttttacctaaattaaaagaactaattaaataaataaatcctaagatttaaagaaataataagctataacagtataagtcatataactaatagttaaagaattaaccttaaaaccttcctaatactctagtttaattaggggtaaataagaggtagaatataataaattcctaaactactactatactaatctagaataactttaagaaatagtctattttattaataataagcagaggaatataattgataatcttaaaattaaactagctaaggaatagctttatatttaagaaaaaaaaaaggtattattcttactaaggactaaaatttaaagagaagaatataaaattaaaaatctaatagcttaatataattaatatattattagaattactaagataactatattataactttagatagaaatatatagatagaaggttctattataaattaataaagattcttaaccctttaaagttatttaatagaaagaacctataatttaataactagcttatactaataaagcttaatataatactaattatttaattctttttaatatatttatatagcttcttattataaaaaggacgctagtaaatataaaatatctaagtaaggagctctaaattagtattaagacttagataatatacttaaatatttaaaataactcttttataacctaaattaatttattaatattaaatataaattttaaattttataaaaattagtaataaattctataatttctttattaagttcctttatctaataaaggaagctaaggttaatataaataattagaaaaaagagctctattaaaagattatacttaagctttaataactaattataatagaggtattaaaagctaataataccttttaagattttatagattactatttatagattataaactatttagaagttatcttaattacacctaatagaattacttttttataaaggtatttgaaaaggtaaagataaaagaacctaaagactctacagaggagggcttcaaaagttattgcacatgctaacaaattagtggtattttatctgtaacaggaggtaatgatgcttagtcagcatacctataattctagttaagaatggcaggtagattaggggagctgcccctaaatattagtgaccctttaactagagttagggataactacctctaaattaaaaaacatagactatataagatgctagtattttacagatcatttagaagctattttactagtgtgagcaataacttttgaagccctcctctgtactagctagctaagaaataaactagcttaggaaaagtccttattttaagtagatacttattaactttatatagattaaacctaaaaaattattaaagtaagagaaaaagagctttattatacttagttagctagttactaataaatatatagttttaatctaagccttaggtaatataagagtaaatagttttatagcccctaaagttttaaggctatctctaaactagaattcctatagtccttaaaaagcttatagacttaaggctattatatatatagctcttaggatataaagataattatatttattatctcttaacccttaataactagtttatttaatctttaaacatttacttctaagaggagtagccttatatattagactttaataacttaggtactatataaaaagataataattctaataataaatctataaaaataattttataaaagacctagtaaagataccttttaatataatattaatttggcgaaaatctacaattatgataacattgggtgcagaaggttgcagaagtttataaaaactatctatatagaagtctactagtctatttatattagtcttagcatctattagaaaaatattcttccttctgttcctgccttaagcttatattatataattattatatgacttctgaactagcagattagtaactagctaactctatctactgtattactcttatttagatagttaataacatactacttctaattatactcctactgttgaaagggacttcaattaaaagctccagccaggagtaagccaaagaattagtatagtattactatataataagccttaagaagaaaaccaggattctgtaataatcccttatgatttactaaagatattaaaatcttactctagtaaaagtttttaagactcttttattactaaaagtaaacctcactaaagatagatttaaaacttagaataccttaattaaggctctttttaagtaaagctaattataaaactaaagatctaaaaaggaaggaaaaaacttcttttttattttatttaactaagtaaagagactgtttaaattaataaataattatataatatacttccctattatatttccctcccccctttagaatattaatatccttattaataagaggtaagaataaaactagataaaggtaaaaaagaaacttataaagaactttttacttaaatataagaaaatagtaagtaatataggtaatctagtaaaaaaagaataatatgctttagaactataaaaataatttttttatctatatcaataacctaatcttaactatctatagtactttctataataataatctcaataaagattatataaggtaatatatagccttatattagttaaactagacttattttagcttaaaagggttagactattaggattttatattaattccttatctaactccttttttaaaactctttctttatctaacttcttattacttcctaatttagactcttcctcctctttaatctcctctaactctactactcttagtctcttactattatatagttttttaatatatttattattcttttttaaaagctaaaaggctaattactctttaaatagttctttttttattttaaacttagcctatttacttctattctaataaaggccttaaagtaagtataatataagttaattactctttaaaacttagataacttattataaaagagtatattaagtttttataaaactataggtttttctatttaatctagccttataatacttctataatagcgcctataaaaggtatataaatagatataaaaaaagtattttatatctcctttttagcctttattttcctattcctagtataactattagaggttattacttttaggcattaggtattctttttaattatactagctcctagaacctttagttattaagggtttccccttactactatatatataaataataggactagtattatctcttaggctagtccttatctctaaagaggtaatattagatactaaagaataatattacttagctaattactaaaggccttttaattatttttttcctaatttataatataattaaaaatctctttagcttaaataccttacaacttcttttaatactctaaactattataggtatagctattattctgttaactatttatattatttagcctaagtagtaaataaaatatttaggttattcttaataataaaaattattaatggtaggtacctatataatatttttattttataaaacctcttactattctcttaaaagtaaatttataaagtctatactagaaagtatatagtatatctagatttagtttatgtaagtatgctattattttaataattatagtctgctttttttacttattaggggtttactttatacttattatttattattttatattattattcctatcttcttaaggtattatcctttaagaaataatttatatagattattaaggtttaatagaccttttttactcctatttatataaggaccttatataagctgccttaaggatctatatttaaataatagacttatactctttactctttattactaagcttaggtactttcttagctatttaatctagaataaactctaagtctagaggtataataaaagctaagtttatttttctttagtttaaactaacttagctcttcctttattagaatctttaacttattatttagttaatcttttgctctttaatatctactataataagttaaaggagctaatatctacctttttcagggttattagatactctataatagacaaattaattatcttatatactctctcttattctaaataataggttattactaggacattataataatatataaagcttttccttactaatattaattataaatataatagaatatcttctccttaaactccttttatatattcctaattcctttaggtactcttttaattctccttaatatatttagtagctctcttaagttagtttaaagttctttattattagcttttagctatttaaaatttacctactttttaataaatcttataaactaattaataggagtattattttactatatttaggcttagactaataatattactactattttcatatataaagccttatataattctttattactagtatcttaaagatactgcctaaagtaatttatagctttatttagggtttagaacccttttctgtctataagaattaggttagtagttaggacagcctttattaaggtaataggtaataatattaaaatagctatggtagaggttaatgtatcttcattatttctaataaaaggtactattagtctattaatagatagctattaaaaaggtgtaggtataccattaatagtacttattctctaatctaaaccagctattcctagattatatttctggctcttataatatagtacctttctataatataaataatagtttatctcctatattattttctatttaattataccctttgggagctaatcctataatttcttttataatcttagtaacctctcctaatattaataataataggcttaatgctcttagattaatattgcctccttttataataggttatataggatactatataacctataataactattctttttaggttctaaataaagccctctctatatttatatttattaccttttagtataactaggcaaaactctactaaggagtactaccttaaccatattatatagagccctttaggggcatattaatattaatatgtttttaaagattagagtaaagggattcttaaataatagtctaaaataaaaataaaataaaaagcaaaggcaagactaaagtaaagctataagtataagaataaaaggaaataagtaaaaaagaatattttattttttaatatattattttttatctttaataccctaattccttatataaagccttaaaatttatttcctctttactaaattataactttttattagtatattcttctttatttattaaaatatcctaaataaagagttatatagtattaaaataataaaactctaaagtacttatccctttaggcctttttagggttattaaaaattaagtaatttttaaggactcttctaactaatacttatccttaattaagtattatatttcttttttttattagaagctcttttatcactctaaaattactttaaatatataattataataaaggttatggggctattttaatataattaaaaaaggataaatgatatctattataatttaagagtagaatctaggctaataataaagaggaaatataatattctatagaaagtatattaaagttactaaagaagttctactcttatcttataggatttattttaaaaatagatataaagatacttatagcttaattaaattatatagctatagatctacctagatctattataatttattagattacttagatttatttatttaattttatagtttaatatatacctagtaattagaatatagctatagataagctttctagatacctacctatataaaaagaagtagaagaagctatataagaggatattaatgcctttcttaatatataattattatattcctttatatagccttatatttattaaaaatttatctagcttattatcctagtataagaattagggtctaaaaaattagcataagaatatatataacttaaaataatatgtatttttaatccttttaaatttctttattagaactagtagataaaaactaatatatattcctttacaaaaatcttctttaatagatttcttttttaaatataataaagtcccttttaataaaaagtctaaggatataatagccttttatatatacctttaggacttatatagtagataagatttccttaaaattagattaatataatatagtactagaatttatatagattataaagcagattttaaaagataagatattgtataattataatatttatttaaataatatacttattaaagggctaaagacctaatataataataaagaagttttacctagaatttagagggttatttataaatatttagagagtttagactaaatactttataatattaagttagctagtattataattattcaaaaagaatcttaatttattatagtagctataaagataattagctatatttataactataaaaagaggtatttttaatagcaaaaagtaattaagattttagaatagttatatttatatctttttcagaggcttagagcttcctaaggcttataatatattgtaaagtctagattaaggattttactattattatatatatatctaatttatagcttattttagagagatagtagtgttttaaaagagtagtaataaataataatataaataaaaataaaattatttttataatattgtattttaagatcttaatcttttaaaatttagccttagactatttagataactattttattatatttttatattaatactattttaatatacttaaggtgtatattattcgtattctttataatattttaatagtaatttttaaagaaaaagtactattaaatgatatttaatataacttttcaataatttttaatctctatttattataagcttataattataaaatattttattattttagaaagggtttttaatattatacttatatagttctaaattttattattttattctaaaataattatatactattataaaacatgatttatattttatttttaattaactttaatctaaataaatttaagatttttaaatatatgaaaatatttaaaattaataatttttattaaaaatactatataaagatttataaattaaaaactattagtttttagttataattaataatataaattaatttacctagttagattattaatttttaaattataactaaaaatatatttaaaaacctatcatactatatttatttaaaattagatatataattatttataaaatttattctaaatctttataatattcgtattattatatttcatttttatattagtctttatttatataattataaattaataactagttaagctaatatttttatttagatttaaagttatatataattattattagctttttaataacttagtttaacgatttaagcttaaatttttttatagatttttataattttataagtctttttaaataaaagcttttttattactataaaaaaataaaaaataaaactactaaataggtattaaagtaagaaattttaagtttatttttatacaaataacgtatttcccggctgtttcgatcacccggttgttccgatcactagaataccatacaaaatgcgtttttttgtacgctcatacctcaacaagctttaaagatattaaagagatattttatatactataattataaagtatttacagcatacagcattaatcagaagtagtctactctattatttactggaataacataaaatacagtgtaatttttgtaaaattaaaaaataggtatctaaaaagcaatatatataatattaaccttatatttctcttacaagtagttatacctatatataaattctactgttactaagatacttacttggggtcagtaagacttcttactactagtggtatacttcggtatagctctagtaggcgttgcctctgacctagtcgttgtcattcattcatctgacttacctttatcgtgtccctgtgagacccctttatacttgtgaaaggtcgttcgaggaagagcccttcgccaggtagtccgctgtctcgagagaggagacccgggtcagttagaccgtcgcgtgctcgtgaacgacacagagtcaggaagactccttgatccttccctaaccaccattgttaagtatcgacgactacggttggacccagcgcgtaacaaaaggatggatggatggaaggatgttgccaatatttgcttggcttctagtctattgatactcgattggtgtctacggagcagactattcttgaattcatccgttgaatggaaattccgtctggtctggagccgattatgatgacaaagatgacgataatgctgttatgcgagtctatactatgtaaggacgagggaaggatccgggaaggtaaactgtgcaatcagattacaatctgctacgcatacaaataacgctttggtatagaatgctatcaggttcagatatatagatgtttcatttacagtacaacacaacaaaggaaaagcccagtcaagtcaggtgcagtgcaattcggaaaatctattacaacgccagcatcttcttgatctccgcaatcgccttgcccgggttcagtcccttcgggcacgtccgcgagcagttcaggatcgtgtggcatcggtacacgctcatgctgttgttcagcatctgcttgcgctcttccttcttctcgtcccgagagtccgccagccaccggtacgactgcagcagaatcgccggtcccaggtactcttcgctgttccaccagtacgacgggcacgacgtcgagcagcacgcgcacagaatgcactcatacagaccgtccagcttccggcgctcctctggggattgacggttctccaggccctacggcgggtcagaacggaaatcgcatcgacagaaaaagatacttacgtctggcgacttggtctcccgctgcaggtacggcttgatcgacttgtactgcttgtagaagtgggtcaggtcaggaaccaggtccttgaccacatacatgtgcggcagagggtagatgcgagaagccttggaggtgtcggtgggaatccggccttgcgatccgtcagcatccatccatcacaacgccacaaaccattttcgtgtacatacacagacaagccagcgtgttgactccgtcaatgttcatcgcgcagctcccgcagatgccctctcggcagctgcggcggaaggtcagggtcgggtcgatctcgttcttgattcggatcagcgcatccagcatcataggacccgtcttgttcagatccaactggtaggtctgcatgcgaggcttctccgtcggacggtcggggtcccatcggtagatgtggaaggtcttgatccgaggctgtttcgacggcgcgggctcgttcacattcgaggtctgcgattcagggacaggcttggtgctggccgaggcggcctcagtgaccttggagatagggtcgacggtggcataggaccgcgcaaacaccgagggcgcggtcaagaacggccgggaggaggccagcaggcgcgaggaggatcgaagagcggccattgtgggcagcagacgagaggcagccgcaataactcagtgaagagcgcggcaggcaatggctatgaggagtggagaggtgatgacgaggtagagattgcgatgaaacagacgccagtggtgaagttgagttgcagagggtcgcctgcttgttagcctaaagcctcgccctagtaacctcgggacggccgttcggcagtggctgactcagcggcgcccgccaatcaggcgcgctctaattccaagcgtcggagactcacggcacaacggatgcacgtgagctcccagtggccggtatcaatcagcatcgtctggagcatatcaatagaacgttgctagtctggtaataataatcgagcttccttacgtccatctggagtgctggttctggcgaaaccctcgtcccattccagcagttccttccctccggagtttaaccaagtcaattgccgacagccagtcacaatgcagcaaattccatcaagtgatttgtctggtatctgcttatgtaatgacttagtcatctgtttggttagttaagttaactagttaacgtaatcaaccaccgagcgacgaataccaccgagcgacgaattttcgccgcacccactataattttgaagcttttcaaccaccaatacaattaaattagactatctagtagttgaatatatagctatttattaggacaattccttatggtatgtccaatagtcccacagccactgcagcgttgtggagctcgccgttgaggcataggtgtaggctcatcaagcttctcattaagctgcgtatcaagctgctgaatgcgattttggcctttcttgtacagagtaaaaggtatcattacctagaatagcacgccttcttgccaaaaaacacaaaggggagtcaggataggagaggtggcttaataagcatgattagataatctatgcctagtgagcctggttctatgggttagactaggtagtagggttcttgcttaatcattagctcctatgtgccacttcctagtggctatttttgtctcctttaggaattcaactaaactttcttggccgtccttagaaaagagatagaaaagattataatcttttctatctatcctagagaatgctctatatctgacatctctataggctgggcaatggaatagtagatgatatggggtctgctcctgattggtttggcatagattgcatggactcgcacatcccgtccgaggacgatattttactcatctttaacggtcagacggggggaaggctgctggatgtgcccgcgccgctgagttaccgtctgcagaggcagaaattcctcaagttaatcgcaacaggcgttgaaatccaggttggatacaccacgctgtcaccctgcacgccgattgcagcacatgtttgactgttggattccagtatggcaagcgtctcgttggggtagagtccgattcgaagacggcgacggcgatctttgaggatggcacccgcgcgacaggaagactgttgatcgggaccgagggagcccattcgcgggtccgtgaatatctcctgggtgagaagggagcattgcacccgtcgcctatagtcgccaccgcgaccgtcatgcgtctaccggaagatgtcgttcggagtgtgagagaacttcatccgcgatactgcattgcttttcatccggatggctacttcatgtggctcgggagtaagtccactgtgttcttctcaggattgatgtaacttttcactgaccggcaatctcagttcacagccaagctgaaaagctagccgactgcgaattcatgttccttctgtcatggatctccgaatctgaaactggcttgtcgggcgagaaaatcctggaggatttgaaaaaacgagctctcattttcggcgagcccttccagaaggtcatgctgtcgattagccctcagacgcgactgtggcataaccggctctcatactggcccactgccgtgggacagccgtaatggtacggtcacgttggccggcgatgcggctcacccgatgacattccgtaagttcccctgcttaatttcctggtgatgattgctaagtattcgattgctgctgcagaccgtgggcagggtctcaacaatgccatcctcgacgcggcatcgttaggccgccagatcgctctgctgaaggataagtcagtcgactctttagctcctgctgtggcggcgtatgaaaaggaggtttgggagagaggtaaagaggccgtgaagatgtcgaacgtgaatagtctctccatccacaattgggagcagctgcaaagctcccctcttttcactgccgggttgaagcagaaagcagcgaagcccgagaaatcatcgtgaatgtcgttgtcggagggaaatatgtgtatataaagtatctaaggtatataagcaggtgtagtacacgtagatacgaggaaaccatcgatggagactgtcacgacgatccattttgacaaagctggcttgacaagactccatggtctcgtgatcaatacgccggccctacccctaagtcccggacaggcatagctgctagcgtcgatctccagatcgcttgacaaaggatcaaattgtatttaccgagtactccattcttcttgctcttctcacaaagcttttgagaatacctggctggtgagaaatggaaagagcaggcaatctgcatacacctaaacaattattatcaggctgacaaaccgcagacacaccttcgcttttacaacctggaacattgtcgtgtctatttcccttgcaacgacgcgacaaacttctctaatttctctcttttcatttggagataccctctcaagacaggcctctatcgctgagcaactctatctctgtatctattccgatgccagcgcctccttcgcagtgatgcgctccaaaaatttatacgttctaggcagctttgcaagacgccttatttcctccagacaatctcgcggccattatgcgaaaagatgacacataactgcaatgcgtgtccgttcctcttcccacaaacatttcggaagatggcacgaatctttcccatcttggcaatcgcatgattttcacatggcacagatccttcgcatagaggaccatgaaacttgtcgtttccagtggggataatttagagctaggaggatagatgagaggcgagtatcgctaggcgcttatcatgcaaatgaatggatgctgaaatgaaatattggaatctgccaattatcacaaatcatgaggtcatgagcatacaacaagtgacagaaactctcagtcaaggaaaagtaatcctgcctatagctggagatggcaaataccacaagcgacagcgggtgcatatccttgggcccaaaatcgggctcagcgacgaagcaattcgaggtcgctcttatcgactgggaagatgctggctggtatccaagctactgggagtattgtgcaatctttgtggcattcgattggcaggatgactggcctgagcggctagaggggattctggacccttggccgagtgaggctacgatgctacggatgctttattaggacttgtggttctgaatacgatattttgctcgaaatttgcagacgtgaacccgaattattttgtcctcaggaatatcgccaggggaggaagtgacaaaccgtaaggagttacaccaggtttgcactgctcccaggatgtcctcgagtctaaaacacttgttacccttccacaatgataattgtgtggctgcaaggaaatcacaatccacagtagttcccccgctgaatgtgaggtggttggcgatacccccatgccgctgattggtcgacgtttgtcaagtaaatacatacatggagacgccaatcagagtctggatggaagcgccgttgtgacctgtagcattcgaggatccatacatgtacctagggtatgtgttacgcgctgggtccaaccgtagttgtcgatacttaacagtggtggttagggaaggatcaaggagtcttcctgactctatgtcgttcacgagcacgcgacggtctaactgacccgggtctcttctccttgagacaacggcctaactggcgaagggctcttcctcgaacgacctctctcagagatataatggggtctcacaggaacacgcaacaagtggggattctccaaggcaaaataacaacaacgactaggtcagaggcaacgcctactagagctataccgaaggctaaccggcctccttgacttacgaagaacaccaaaatcagcacctacaaaaaacacgtctttttaacgcgtcattcaactcagagaggcccctaggccccgagaaaccaccatggaaccccccgatctccatggtggtggtgttattcacgcgtcacccccggcaaacggccacgcggcaagccagctcacggagatcctggaggtaccagacaccccaaccccaagccgatggaatattccagggcccctagggctggttatgaatgagaccgagcaggaaaatgatcaaggaaaccatgaagaagttcaggatccccctagattccttagggatggtaaggcaccatgccaggccagcaaaggccgcggtataaccaaacagcaacgacgagtcatccagagacccttagggaataaagaagcactccgaaccaccaaaaggtgatcccaatgaagcaccagggctgcctatgcaacctgccgataaaccgatgagaatcactgccgtggtagtcctatgaaccgatgagaatgactgctggagcagtcccgatgaactaatggggcagaggccgtcgatacggcttaccctcgaaccgatgagtagctgccaatacagcttccgatgaaaccagtgagaccaatgaggagatagacgagcgaatcctaatgtgaagggccaaagccttgctgtctagaaactaggagctcataaaaaggattcgctggggaaggaagaaaggaagagaaaggcacgcgagctgtatcaacaggagtcatgtgataaacaacaaatagaccaatcagaagacgagagcgaagctgagtcagcaatatgggcttagcccgcaacaagattggtgattttctggcgcaagaatcatctggggaggtaaggcccatccagctgcatttactgcaataattgcagtcacccattcacgattcgcaggttgtatagctcttgcatgactctgtcatgtttctgatccacagacaactttggcagttgaaatcacatgcatttggaagccagtctcatccatgttgtagatatcttgtgtaaggattccataattttgactagtatcatagaaccggttgaaccaccccttgatcagctctggatcttcacatttagcttggtggtaatcatacttttggctgtatttagagcaaagttcattgtggcacttgatatactgggttacgcagttctcaccaatgaaggctctttgggaggatgatagccgggtagatagcaataactatgccagatagcatacagttgatattcgcggaggtaaaccacattggtccatatccagaatccatgttgaaagtgtattctctttagtgtctgtcaattttcgacaactggtgattgcatctttgtaagaagtagtcccactgatacatgttattaaggtacttttaggcatgtcaaatgcatctgcagccttttggattgatagaaagggccctttttataggcctgaagggccaattgaagatgttcctccctagatatatcggccattaggtggtggtgggtggtggtggtaataatagtcaaaaactcggtgttggtgttggggctgaccagcttggtggtatgaccagctcagtagtggattacattagtatctaatagttattatttatatgtactagtatatctatcttataataagataaggtattagcctttatattctataaagctagctaatatataataataaagttaaacttagggcaagtgagtgcacccggattgatgcaattgcctggcggagagcgattgtatcctcatcctcttgtgagcgctcttgcctcttggcataaggtgcaacagcatcggttgcggggcgctttcgaagcggcccgggccgtgttggggcgcactcctctacatcacagaacgcaatcactgcattgattgcggcaatccggcgctgatactccgcttcgatggtggcgcctggcagagtcaggacggtgtcgatcagtatcatgtgctgcggtgtcatatttctctgaaagaggccacggtttcgggagaggtgattaagaaatgaacgctctccaaatgctaaaatccacccaatcatttcagccaggcggatacacggtggctaggctgcaaatcaaggcgaccagccattcgctcagtaggactaacaccataaaaaaggcgaaaaagacactttctggagagactcaggagtctggaaagattcagtagtttgtgttggaattcgtggcataccagtctaactggattcggtagtcatataagctgatgtgatacatcatattggaagccgataccccgcttcttacaataaggcttatacgccaggtcgcccacatctgattagaatcaggaaaaagtctccttcatatcattatattgtcttctatagtgatgcttgtagaagcttctcccctacatgcttatagccataacctcaacagtctgaacagactcggtagactggaaagactcagtaatctggagagactcggcattctgaaaaggctctgcagtccagagagactcagtagtctggaaagaccgagcagtccaaagagacacggcagcctgaacagactcgaaagtctcaagggaccgatagcccggaaagactcagtagggactgccaagtctctccagactataggtctgttcagactgccgagtctttccagtctagcaaatctgttcagactactgaatctttccagactcctgagtctctccagactactgagtctttccagactatgggtctcttcagaccgccaggcctgttcagactgccgagtccctccagactttgggcctctttgggctgctgagtctgttgagactactgatcctcgaggtatggacaagagggaaagcccttagtggaatttgaccccataaacgatgtggctgatcagatggatggaccagacgggagcagggataccgcctgtaccccagacaacacgctcaagtattgactaatcacacataataacgaggtggaattctctgtgtcaggtggtggaagaatgtgctgcagttgacaaggtgaggccaaatcttattaaacttgctattgtcaggaatggggcatagcctcatatttacactaatagttcaatgccatccactgcccatgatatacagtacagaagagccatgtaaaaggctctatagagcattattctatagcagcaagggaatataatgtctctcataatcattgctctaacatcttattagaggagccatccatagttgttcatctgggttttaagcaggtcaattgccaactcctatgtttggtcgcttttaaagttcaacaatgtactctatggcaaacacgtgttgacctcaggatcaagcatcaccttgatcctctgcatggtgtttagcccactttattagctgtctggaaagacgtcggatcacagcgccagcagtaaatctagaagtcgctggtgcatgtgcaatatcagtgcatgtgggagtcaggattatgtctaatggccatttatacatacaaccacaattttctagaaaatctcctaggcatgtgctaataagagttactttcagcatgtagatactatgctttgaagaccaattaactagtgttcattatttttgtagacttaagcctaagaaccttttcaataatgctttttcataatgtctgtgtaaaaacttaatctactatcaaactattttgattacttttcacattctatgtagtgaccacaactctttattaataaatctcagaaagacaccttgtactcgaacatattggctattctctctggtgattcgtcaattaaggattgatgtccttgcacgccacatcctccaaggacttcctaattggcactggatagatagtttcctgttcttgttagttcaatgcggggttgaaatgatagttgttggtagtcaacgtactaattgctggagcgtcagtagccattgttctacagagtcagaggttaaagtgtatatctggccattctttctggagcagagtatcatgaagacatctgaatcacatattgtcaagacctcgcgatgaaggcaaaacttgttgtattcgagatatctaacctatcaaaaaggtgcagaaccgacagagagggaaggagaagaaaacaaagaagacaaagaaactcgatgtgcgacttgacaagttgactagaagcgaggtcatgtggaaagcaaccacgtgaccagtcaggtctgcgccagggcctgacacatataatggaatattccttaactttcttaaataacccctttctgcggcggtttctttgttgattctttaacctctggctctgtgattggccctttttgggaatttgagtcttctgggtcatcatgattggccactagcagcttctggatgatgctgcttgcggttaagggaagtagaggataaggagatgttagcaattggagagctctggtatttatatctcttcattatcgatctctattccagaaagtgtctttttcgctttttttatggtgtcagtcctactgagcggatggctggtcgccttgatttgcagcctagccaccgtgtatccgcctggctgaaatgattgggtggattttagcatttggagagcattcatttcttatcacctctcctgaaaccgtggcctctttcagagaaatcatggagcctacaaaatgggagcaaaattgcctccttttctgcgagtccttcggagcttgcgatccctttttgaagctggtacaagtcttataccgcggcaggttttgatgcgatccattttgccgcaagccattcctgtttgttggcgaatctacaacagtgttttaggagatgttagcaattggagagctctggtatttatatctcttcattatcgatctctattccagaaagtgtctttttcgctttttttatggtgtcagtcctactgagcggatggctggtcgccttgatttgcagcctagccaccgtgtatccgcctggctgaaatgattgggtggattttagcatttggagagcattcatttcttatcacctctcctgaaaccgtggcctctttcagagaaatcatggagcctacaaaatgggagcaaaattgcctccttttctgcgagtccttcggagcttgcgatccctttttgaagctggtacaagtcttataccgcggcaggttttgatgcgatccattttgccgcaagccattcctgtttgttggcgaatctacaacagtgtttttgtggtgtttggcttaactatattaggttagcgctcctctctcaccaacatagtaaagcggatattgattggagaatactttggcctgcgagagcaggcacacaaccagggcgcttgtgtcacagtcctgaactggagccaacaattgatgtcatgtgattatgcaggccagacttgataagtagtggctgcctataagcagtcctcaggtcgctgaaattaaaaataagagagagagagagagggaaggagacagagagcgctgcagtgcagctaattgactgataacgcagaaaaattccaactacaactaatgggttcaaactcaaccgtgatgtgtcttgggtggttctttgcatctggcagcatagttgcaaccttcccagatggcacgacatcacaaagcagagaagcagatccagaaaacatactataaaaagatagtcctaatttcatcagcacttcgtctttagctgagactttgggcaacatcagagggatgatattctggagaaagtgtcgccaccatcttcatgacgccgttagtcgtataaggaattatcaaatcccaaactgctttgagcaggaatactatgcccattaacagtcaaggccagtcgaacgtgagtcgcagagagcctgacaccttcgctggcagcgacgttgtgagcgactttaacaatatttttgatctaggtttacattcatgttagcgcttggattctttgaatttccaatcattctcacctctcgcccattgagtttgatccccgcaaatatacggagctcctcctcctcaacgctggcgcttcgaagcccggaccctccttactctccttgtccttcgtcctccatctccatctttcttcagaccctccggtcgacatgctggaccttcatagcttgatgcagatcgttcctcaagaacggctttgaatagatccttcagttcacccctggagatgcactgatcagaggtaaggcgaggacttcctggaggagtatgcgcttcagggtaagggaaggaagcagcaactgaacacttgttggaaggcattgttcgagaccaattggtatgattgtaagtgtttctcgttgacagaatgagactgaaagtagagctgtacagtgcgtgagaattgtactgatggattgcaaggacgattcacagagggaactttgcctccttttatgcccatcaaggagcacccttgccgcagggaataacgcattttccttttgctatttcccctcatgatattcctcatgagatgcatttcatagaacttggccataatgaggttcctccctatcacccttctccgtcaccccttggaaggcgctagtacgaaaattgaaaattgaatggtaccttaccattcgaggagcactttgagactttgagtggtcaccctcggaatattcggcttccgcgcgcgacgtggcatcgtcacatggggttccatacgttagtatttaatcgcatgtagtcgcacgcggtcgcatgctcctatttctcctttctcccctttcccagtgcgatcaggagttactccggttactcctaaaaatggaagcggatatctcaataaagcaaataacgcaaacttattccctgttttatgaggatgagcgtgagttgactgacgaggagaatgagtcgattcgcttgtgttgtgatttgtttcgtcatatcactacgtcaacagagcctctctcaacatcccaacaatataggaggattagagcccgcaacttgcttacagaggtgtatctgaaagttggggccgaagtatttttgctgtgcatgctgacgtggtctatcacggcattggcaaggtttgattcaaagatcgttcttccaaagtttctccaatggtggaagagcactcctacgaaggaaggcctaaaacgtaccgctgataaaatctgcaacgactatgggattaagaagctagtcaaacaagtgaaaacgttttctggaagtatgcatgtattctttaacggggtctgttctgttcggatactaagctgataaatttctgcagggtccagtaccagaagacgtacacgactactgaagaaccaagtcagcaaaagtgtcgaccaagaccagcctgaccgagccgagcataaggatggcacatcggttgacggatcctcatccgatgcccatccacagacctacgagggccaaagtcatggccctgtggtattgaaggttgatgacataccagagttgcaaatatctcttctatcagaccagcacccacaatcagttttcgacctccaaattgtacatctcatggcgttcctccaacaatatcacccaacatcttccaacccagaacagctttcaaggattctcagtttatttgaggggtaccagttcatctgtccgcacatacagctagtttatccgtggtacggctctgtcccctcaatcgatatcaagatagactccaaaatcggctggagcgcaaaggtgcagctatctcacaaattggcggaagaactgattgaatacattcaaaacctcatgcgtgtcgacgtcggaaacggaggacatagggattcccaacaagactaagtttctcccctgatttggccgcgacaaggacttttccggttagtctgctagtcagagtgtatttagaagggtcaccattgactctagcgacccctccaggtggccgattttgaagaagaactgcgcgcacgtccgggtttgactcgaatccgttcactatctcccattcctggtctaggataacatcttctccagtctttatttagttagtagaattttttgttggagacgtttgagcagttcatacaatgagttttgccttttgttcgagtttctctcgatcgtcgataatgtcatcgactgaaattccaggatcttcaacttctgtcacgttcggcatatgtgtgagttcgggagtttggatctggagccgagtgaatggaagaacgtgatggacaagagcagcggcgaggagcacgagaaattagaaaaaaaaaagtcgtctttcttgggcttgacttaacagaatatgagtctgtaagtaggtacatatggcgaagagtttcaggttagatccttttcgtagtgatggaatcggaatttgggcatcacttagtgatttcattcgggaaggtcctcacactaactcttccgcggggctgagtctggtgactcgaaagcggctgcggggcattggtagcaacccctacagttcagacggtgcattcaaggtcacgaaaatccaaagtcatagaaaagttgacttttactgagactgttaatgaaacttccaaaatgaataactaaaaaatccaaaatccactgcaacagattgtatcagacttcgtctctgatttttcgggatgtgtaattttccgagttgcgcggcgtcgcattcattctcaataagtcgcgtaaagttgcatcaaatcgcacagttagccccgcattcacgcggtttcgggagatatgcctctcagctcgtccagaccaatatctcgaaaaagctcggagactagtactgaatgctattaactcttgctactcttcatggaataacccaaatatagtagataaatatagttagcacaatccagagggaaggtcattctatttttagcagcgcccgaatcagctctctgttctggaatcgactgttcccttgtcctctgcgatgtctgtcttttctgcgaccctttttgagtacccactggtggcccttcagtgaaggggaacgattctctaaatacaagcccctcccgcctgttgcttttccttctttaactcacttgccagtgggccgtttgtgtctgtgcttaacgacaggcggccttttgctttgtactctcttattttgggtggctttctttttctgtctttcatttctcgattttcttcccctctgggagggtgtttttcgtggtttttctgcagcatgggctttttaacgataacatttcaggtgagttggccacttcataagacagctgcgctactcacgggtgctaatacaggacgcaggaaatggaaacgatgaggattttgaagcaatagcaacacaggaggtaagcaccaaaccatggtatgacagcataataggactgacgaacaggtcatctctaacgtgcacaatgccatgcaattactcagcaggctgggtacgaccagagctacgaagttgctcgacaaagtcaaagaagacggaccaacccctccctctttaatctttcgaagtcacgatgatttagtattccccctcaaagcagtgtcgccgttgccacactctcagaacacaagccataatgacagttcaacggttgatggcctatgtgccacagaggggggccgagcgttgggtaattacctactcttttgttatgcaggctgccaattcctacttggctgtctatgccaccgactcggatgcctgtatatttctagatattgacaatgaaatctcaactatgccggcaaatgacgggcctgagaatgatttggatctaccagactctggcgatctcgcttcatgggctgattcaataattgactgggataacatttttcccaattatgatttgcaaccggatgacgggctcgctccgccctcggggacactgcagaaggagcagatgatcatccctcatctgtcccattagcaagaaatgccgtcgaacaagaattaactgactcgccgaaaccggtcgcgtgtactgaccaaggagattcctttcctaatccatcagagtgccttttgactggagacgcggaatcggatactgatggtgatggtggcataggccttctcacacagccatccgattcgaaaccagaaccattcaaggtgagcaaaaccagaagaccacgcaaaagactcggcaatggaagccgttaaaaagggacagtggctgggtgaagaaccggtccacaaggttggccaagatgaagtagaggaccttgcgtcatctctaatgcggaataccttgggaggacactacctgacgaggatcttcaacaggtccggcaagtcagcgaagggctcattgacgatgatttacccgtttttgagtttttgcaaaataacctcaggttgatatggagctaatccggtctcatgaaaggccttgcggatgacgtttccacggaacgttttctcacgtatagatgacaaggcacagaggaaatcaagccgtgcagactccctgcatcctgtacatacgaacgtggttttgtacattctattgactttccaactttcccatccccctttccccctcccctctttataagggcactctgctgaccggggcctagagcctgcggagcccatgcgccagtgggacccccgtgggctcatcgaccccatctacgagggtaaacgccgtcagcgcgctgtggcaaagaaagcagaggatctgaaggccaagctgctggagaagctagacaggattgcgaacatgaacgacggggtggccaacacgattcgggagctcaagggggagttagagaaggatcacaaagacctacaccggttgatcctcaacctcaacctgcactggagcagtatcgaggacgatattgggcgtgagtatggatatgatgatcctaccgatgatcagctcaagattcttagcttggcctacaccgatgctgtggaggagtgggatcgcgagtactgaagcttggtgatccgaagaggagcaatcccatggcaaggagctgtaccctctgcagaacaaggcgaagagctgaagaaagctctgcagacagctctggagacgcaagatgctatcgaaaagctctcccctgttgagaaggagctcatgtcccaggcagcccaggcgagtctccggaaacataacacaggcaagtagtctgccaaggaagagcacaacggcatagagaaggatgcttgattgacgaaagacactatgtgaattctttatatagcctagcatgcgttgtgaaaccagtcaaagccacaaatctgtctctttctcgcaggcttgcggctagacctgttgtcgtaatcaacactacgactgctggcatccttgtgagggctggaatgaattccataagtttctcaacgatcaagcagtaaaacagacatcaagcctttggcatggaatcttccataacaggaaacaggggcacggcatcctagagattaagcatctcatcaacggtctgatgggacaccaaattgccctccctcgcctgctgcattttcttctgaacaaagccatcaagattcacccgctcttcttcatttagaagatccattcgatcctggattgtggtaaaaggcccatagtactttcgatcgataaaggtccagtagatttcgtcgaacatagagctgtgtcttgcggcaagacagacccagaatagcccattctccatcgagttttccatagcccctgatagacgttgcgaatctgataaggaaccctcgttgatttttgcagtctcacactctcgaagggcctccaaaaaaatgcgcaattttgggatatagcgcactaaaaattggttaagatccggctcccattcctccgggcgctccaacaatagccaccatggcgcggtatagatgaattcagctggggcagcgtatgtaaactcccaatcaataactccagtgacaattgatcttgacgtatcaacaagaacgttatcgggccgaagatcatcacaaaagagtcggaaagggccattgcagtgttccttggatacttcccgcgatatcttgcgaaaaagacagcgagcaatgtatttcttccggcagtcagcctcatctgtaactgcatcattgcgttgatgctcaagatgatataggtgttgtttggcaagctcctcgaagtaatcggccgcattggtaaagcgttgttttgcaaatataccaggcgggatgtttgagaattgagcgagccgattcatattgaagttgagtggtcgcttcttcacagtccaagctcctaactcgttctgccccagggctccaataaagggaaatgctggttttgccagctcaagcatgatctgagccatgccataataagcccttttcaagtcagactcagaaatcttagggttcaaagtaattgtccctttaagtgggtccctgagatatctagacaagggagtcccttcaataatggtcatgacgatataggggccaactgcacatttgccagaacctagaacctttggaacagggattgctgtattctgagcaagataattcatgattgccacctcatcttctagcttttcattgcgaaaaacgactcgaccgagggcagtaaatcgaaccaagacgcgaaagccgtcttggaaggtgacccggtaacagacattgaaagcaccattcgaaaacagtgaagccgtggttggtgtcccaggccggtgcttagctgcaagctgaccggccagttcttctggtgaatttctgatcaaattctgtaaccatacctggaaaactttatccgaccgctgctctgcaaggtggtcgaaatccatttccgaggggagcgtgggtgaggatctggccggtagtgcctaggtagataggaaggcgaggataggatataaggccctcttaaagacaaacaagctgtaataatgggagcgagaatcaactcaaacaagctttcaagaacaaggaaccgttaagtcggggcatggaacctttgaaagttgcccagctagctgcggggatctcggttggctaaggttactcgccaagattaaccagttacggattaattcaaaacaactctttaatagcttaagaggtaactatcctaatctagtgtgtaaacgtaaaagaccagttacagacagagaagaaagagctgaaaagcatgtgctgtatgcgaaagctgaaataacagaacatcagccgccgcaggcggcgctcctcggcggcagtcgcgttgagccgctgctcgcgctcgcgctgccagtcaatgatggtgtgctgctctgggcgacgagccaagaagagggatgagctggcagcggcagggaggcgggaaccagtgggggtagacatggtgctgccagcccgagacattcagcgatgacacggtcctgataagaggatgagaaaagagggtccatggaaacagggtagaaggttgctgggttgtttccagggctactcaccacgaggtcgctgtaaggtggagagagaaggcaggtctggagtgacagatcaccactgatcagtaaccagactcggtggaagtgcagagcacggccagggaaaggagaggagctaccaggtcaatcgaagaattccatccgaggaagagggtccaacatagtcgaagggggaaggtcactcgcaagtcttacgaaagagactaggtttccttgtgacatcattggtaaaagcaaaaagttctgaagctcctttttccttcggattagaaagagagcttttgatcttcttccattcacaaattgccttccgaagattatgctgtggaatcaagtcatggtaaagctattgtgcgttaggcaccagcactctgataagggcttcacctttccaatatccttggatctctccgcgcgtcccgaaagatggcttttatcctggcatatatgcctttatcttctaccttccatggtccgccatttggaaacaccactttgcgcatcctattgacccacgggatcaatggctcgtaatatggcgtaaaattttcctgtgcagtgctgttgaatatatcctcgtctgatacagtccccagtttcaacttggccaactctttcatcgtcacatagttccacttgtcgaattccgcaacgactctgctaccctcgttcgggccgttataatggatgcatatccaaaagagaacccagaagaacgactctagatcatgcatgaaagaatgcttctcctcaagcaaaagccctatcgccataaatgctctcgtaccggtcttgcctcgtgctccggagggctgttcgcgttgctccttgatcgcaagatctaagtcgatcaaaaacccccttccgttctctcccatcatcaaatttccggtagaaatgtcaccttgaagcatccccgctttcatgtgtaaagactcataacctacaccggtcaacaccgatactaatgatcaacatgattacgtaccttcaatacagtcctcaagcgcaacaagcatggcaacgcgagagctcgctctgtatattggcttcccatagtcacaaataataacgcgacggtgaactctgttttgaataatatgccctcgcccacctttggttggggagctcgagcacgtgcgtttgctcggtgggagtggcgcatcagcacggctggatgacctcttccgtccgacactgctaatatcggtggtgcggcccttcctcactgcgtcgccagcttcacttgctcgttgggatacatcagaaactgaatgcctaaaatttgtcgcctttgccatatccaaccccttgcggacattatcgcagatatcgtcaactttatcgccaatccgtactgtctcatggtggtagtatcttgccatgttaacaacccctttttccgtcgcttcccgcagaagtaaaccttcctcccctctctcggggtactgccacgaatctttaatgacgagaggggttttcgattcatccccttcacgatgggccttccagcaggttgttgctcgtccagcgacgcaaggggcccgcttcatgagcccatcaagaatgaggcgttccgggtggccgtcacgaacgatctcaataaaccgttttccctctgaagatctgatggtgggatcaaatccaagctgttcatcattcatccagagacatcccaagactaccgatacaaactgctgtccgtctttgttgatgtcgaatggcaaggatgcaatacctccagcacggtcaaactcccaaagccgcatgatggatccacagagagtaaaacccacaataaagcgacgactgtcttgtgcagcgaacatctctctcacatatctccccagatcgagccatgttctggaggcagtgtcaagatctggattactcttcagctccccaggaactaggatatgcgaccagtggtggttagaaccatcggtgtcctgtccgccgatgaagccgacatctagcttgcgttcggccgtagatccttgaagtggctgattaggccgcgcccagatccttcgatcagtgtttgtggtaaaaccctgttcttcagccaagtcacggaacaaattgacttgacttgtgagccactgtaagacttcattttgggtcgcatgttctggccagtcacgccagcccgcctcgtcactgtatatgggactgtctccttctttacatcttcgaaagacagcgattcctgcctcttcaagattttctatgtctccaaagaaagccttataaaagtcgggcacgccaacgaagagagacccaagttcctccttcagtacagcgtccacatatttgcggtgttccgaggaattgacgaaactgctggtattatgtagatatggtgtttgaccgaggaagggcagcgaccgcggggggggagtgtgttcggtaacggcattgtagacgtgatcccaaatgacctcatcaggttcattgttgagaaccacagtaagcaaagggacgagttgttcgacgttgaagtcatctgagctgattgctgaattgagtctcagaaggtcactaaatagattcttcctcccgctaacagagggcaagacacgtaaggcaggaagggctcgaaatgcggatactaggtcaagggcgaggttttggataactgcacgtagttaacaagattctgagatctgcccgtgaatattaccttcgttctcaagttgtcttagagcactggaagaatcagggagccctaggtcttgacatgttgacttaaaagagtcacgaaacttgtccagcccccctccgatgggtttcgttctgatgacctctgcccttgagagagacatcttggaggggagaaagcgacatcaaatgagaactgccccggcgcttggagcccgggggagaggggggggggaagatgaatggacggaagaggtgatagagagattcaacaaatggtggtcgaaatgcccgaccgagagaaggagcttgtcaagcggcgcatgtttcaggtccatgcttggcaacaggcaagccgcgtaatatccgagtttgccccaacagcaaagggcgcatctttcaatctgccattcccttgagttcgtgacagggatcttcgacttcttagtcaagcctgtagtcttgcctacaggttgctatcagtatgcgctcaactgcggattctcccttggcaaccagagtccaactgtgtcgcactggaaatttggcgcaatctgaccagtgatttggctacccgtgcccaagggtctaaacctatatccgctctagcagctgtatgaccctgcaatggctagtagattgcacgtgtcgtttggttttcggtcataaaataccctctgggacgagatcctgcattattattattatttagaacggagctaaggacagatcactaaatcacagcagtatgggtaagacctcaatgaggcaaagctcttttctatcgatactttgctgcgggccatacgtaatgcacaacaagcaaattcagttgacatgctgcttacatcaatcaagctttccactctgttagcatcctccagatatcaaggactttcaggtctgctctgtctaataatcgtcgccactcctgttccttgcggagaatcctatctcacgcttgcgtctcgtcacgatatctccgtctgggtcgatattctccatcaaatcgctcttcccggaccacttccaccgtacgtaggaatcgttcgtattgaagaatccacaaaagtcgcaaccgaatggcagttcgtatcttcacatctcgccgtcagctggcaggctcgatatagcaatatctccaatcgaaaatcggtgtctaagaaagtctcctgcatcttcccaaaagaggtcacgtcgcgtccgaattagttgatgcacgtctgaaggacatctggagactgtgccttggccctcagattgctgtggctctgatttttccgtgtcttgcttttgtattgcagagtatgcattgcgtagctcattttgaatgaactgctcaaggttcgggatctctgctgaatggtctgcaatatcctggcacgtatcatttggtgctgggtctttctattgctggtagaactttttttcgatgaggtatctgcaacaagaggaaaacgaggaactgaatcactttaaaatttggagaattgtattccggtctgggtgggagccggtctttgactgcgagcccgttctgatttcacttaggaaccatccataggagggacgaacgacaatagccattattttatccagcactaaattgtgttcgagggccacgccaaacccagtgattgttccttttgtcttgatgcctggtatgttaggatctcgcggcattaggaagacatttggcgcctggccagaagacaaagaccgcagttgaacggccattgctaaaatacgaactataacatcataaggttctcaaccagcaatatggcgctttgcccggctctgggaactattgtcttcaagctttctctttccggtctggacagcatatgcggacaagtattctcgcaactcacttaacgagatttgtccatatccgttcccaattttgtgtcttgaggcatcccttctgccaactaagacaagtcgcttttctaaagcaagcctcgatggtcttttcaccatggattcgtttgctccagcacctgatcagtttcctgacgagaaagattccttctggactacttttaccaacaatgatgactggatatgcgagggtcttgatgtctctgctcttattccgaccttacagactccggtcagccctccaattgatggaccaagtctcaacattccggagagagagattgatttgccgcttttgtcgtcggagaccacggtgcccgataccccagtgcatgctaaaatggagctcagcttggcccagttgaatgagaaagtgcaaaatctagaagaggcgtaagctgtctccgaggatctccggctgatgtcactatctgacaattttgatagggttaaaaaattatctaggtattgtttcctggaactgagaaatagcgggctcagactaatagctcgcagtgagctgtccaagatggagggaagagaaagcgaaacaagaagcggatagaatcgtggatgaaagatattagcaacatattagctgatgtggtcaactgtgaccgcaatgccgccagtggagtccagctgcgcaaacgagcggctcaagtggatgagagtactagttcttgtgatcctaaacgatgctgcattcacagataggggctggaagaaccaaactcgatggggaaggatgaccgtccaacatgggaggccgattgcttgcaccgttttcagagaagagctttaccagggagcctatttgtttagacatttactgtaccttagattgccgcagtgacaagggttcgtcaagacagggtatagctgcatgtaagcttgccgcgcaacctctttgcttcgtcgtctagtgacccggagcggttggataacccctgcccaagcgaatccagacgcgcggaatggaaccaatgaactgcatgctatgctctcgctaagccggggaacacggattgcaattcaagattgatccatgcatttgcccttcgttcctgcatgcgtcgacaggtttgccatggattatgaggcaaccacccaacggttccaggtggccttatcatgctaaagcaagtggtcactccagaaatagaccaagtagacagcgaccgcggatgcctagtgggttgagctcaaatttatcaggggaccaacggttttcagaagggctgtagatgccggtcccaaaacgatacagaacgcgttccgatttcgactcaggggcgcgctcccaatgtcgttatgatgctttagataaattggtccactaccctgacgcaagcgccgcattgatttcccgcagcagcacaccatgtctcgccgacagcatgcgtgttggctcgatgtgggcaccggcaaagacggcgcgttcatcatccgggatttggggtctctcgctcatgtggttggggagttgactcagccggatggacagtaccctgtcctgtcgctgttcctaggcggcaggcaaaagaacgaagccttacgtagtctgtttccgcagaataacatcaaaaggagtcaatcagatgcctgtgttagtttgaggtgcgatgtatcctcatcggcatctactgcgccactcctcttcgccgacagcgatcccctcagaacacccggtccctggcgcgagtccatggcacagcaggggactgtacacccaattttgtggagcgcctcatccgcgaatgaagtcctccgtttcatctacgctcggttgctcttcctctttgctgacgttgtctgcatctttgcgaacgacaccagttccggaagctgcataaggattacaaagcccgcatggaagaaacggctggtgccacgtcagttgaggcaaaacagcaagcgacacgtggatagcagtatttccaggacaggggaaactcaaggatgagagagaacatcagaagatagtggatggaagcagtataatccgcttagaaccattgtggaagccatccttgataagtggattggtcacagccggggcgatcaacagacggagttttgttgagacagaacattggagtctaaattcagatcagacagcggactgcagcgatcaatcacaagaaattatatcagttccctcgacctctggtggatgcaatgagcaggacatctaactaggctctgtatttgatgagtcattagctccatctggtccccactgagcgccagggatgcatcataaacgacaggggtatgtggcccgatctaccagcgttgggccgtttgaatcacactgcgggcattgcgtcagccactgcggagactctcggggtcctttatggttgtacagagtacaagtagcactattttcccactgctgatatgttggactgctggagaaaacaagcagtatatggtcgtttgtgcagagttttgaaaagagggaaaatgacatccaacatggactcactcaaaaaagtgctttctaagtaatgtttggatacgttcccacacttttcaagtgctaatatacgttccagcattctcgaaagcggttcattctctgatctcacattaatttgcgggtcaaagatcttcagagtccattgctgtatcatctgtcctcagtcgaagttcttttgtaaggccctggatggaccatttcaagtatgtatgttttattatggatctgagtttcctgctcatcattgataggaagcctcctcgcgaacaatcacccttcacgatgacgatccgtcaattgtcgagaagatgttgcattacctatatgaagcgaactatgaagatggctcagcatcgagcccttttgaaatcacctgcacagacaatcaagatgaaattttgaggcaagaagaaagcacgaaagagtgtcgcacctcctccatccaaaaaaactcaaacacatttgagcaggggaaccgcgcacatattaatgcccagatgtatgtcattgccgacaaatatggcattacggaactaaaggaactcgcaaaggaaaagtttaaactagctcttgaaagtgattggcaagatttgacattcatttcagtggttgaatttgtttatggtcctaccagccctacaaattcagaactacggggtgtggtaaccaaattcgcccttcaacaccttcctgttctcaaactcagcagcaattccatactgtattaaaggcttatccggattttgcatacgatttcttggtgctgactatggagaaagcgcttccgtttcaacaacaatggtaagtaaaggcaggtgcttttctatgtccaatttgagcatcaacctgagtcgaattcactttagtgacgaacaagctgccgatcaggtgccagttatacccacaacgggcgtgtccctttccccattagcttcgagtcataagagtcgcagtcggcctacccgagaaaattattgtggcgtctgtaaaagatcctttgttgacagatctgctcttcgtcagcatgatacagatgctcattggtggtgcacagattgtaatacaagttttaggtcagttcaaagagctcggacacatcgttcgaaggtacatggaggattttaggatcctataggaacagcttctgcactatgcctagtcggaaggaaatgaaggaataagcagtcaaaagagatagaatgtgacaattatagatcccatgtaaacgcatcatgaatgtcccctttacagtgttgtgccaggttccactgtatataattggcatcatgcatacgtattttttccatgatggataataaaaacaaaaatgacgcagtcacaggaggattgaggactgggtgaatagagaagcaagtttcaaagctatgagcaggccgctctcttatactgcgtctcagtaactaattttatgatccagacacgtgacgcggagactggctgacacctcaacgtcatagtacatctcaacgccaagatttctatattataaaaaatcgattgcaaatatcaacaccacaacaatacaaatttattgattctcaatacaagaagccttccatctatctataagaaccttcctgtgctttttgcaatcaatcgcaagtcgttttgctaactttttgcctcttcgaagatcccgctcttgagcccgctctaacgcctccgtcgctttttgaacctcatcctcatccgtttcttagaaatccgacgcggttgatgggcatataagacgcctcctgactgataaaccctgcggcgtacattttgacgctctcgtcgcgcttgttcaactgctttaagtgttgtttagatcttcctcaagttgctttgcaagatgcgctgtcgcgattgcaccttttacaaggcgttcaaccaggcaatggaatgcagcatagtcacgcaacaaatttaagatttgagtgccaattttctgtattttgcgagcggattgagcgttgagatgcttgagatgatcctcattatcagggtctctggccgctgactattagagcgcggacagcaaagaatatggaagatacagttgcccttgacgtttgggaggccaggaaggctcatcgccagggggataccaagactcaacgccaacagtcaaattgacagtctaacttacaatcatcacactgagggaatccatagtaaggaggggggtattgttgcgggctaagcccatattgctgactcagcttcgctctcgtcttctgattggtctatttgttgtttatcacatgactcctgttgatacagctcgcgtgcctttctcttcctttcttccttccccagcgaatcctttttatgagctcctagtttctagacagcaaggctttggcccttcacattattttatttttattttattttattttttttccctttttattgtggcactaggagttcagaccacgtgcttgcagctattactacctcgacatgaaagcaaatacggacagactgattcagacaaacagagctggaatgatgagtctgccatactggtaatttctctgattcgtatatacaatttacaatcactacagagacatgtatcaggctgattcgtcaggatcatcgagaaatcttcttctatctctttcgttattctattctatctatctgatagactgcgtcttgtagatcatactatggacaaggatatattgagaataggctatttacatgctatctgaactgtactccgtatgaacttgaactatggcatggatatcaagtcctccaccaaatacgatttcaattcaattccatcgtgatcaattaattcgcatgcataggttcatgccttccccgtcgaccccaacatatccataatccgctcaaccgccttctgcatcgcggccgtcgcctcctcatgaacggtcgtcaggggcgccttgcccgcgcgctcggcctgcacgcgcacatactcgttgttcatgaccttgttgatgttgaccttggacacgccgtgggagatgcacttctggaagatatcctcggtgaacgggtcggcgccgtgcagcaccaggcgcacctggtcgcccaccgcctcgttgatgctcgccaaccggtcgtactcgagctggatgccgcgcgggccgtacgagccatgcacgttgccaaacgccggagccagccagtcgatgcccgtcgcgacgaactcgcggctctcctcaggcgtcgtcagcaggcccgtcaggtccgccgtgtcagcgacgccgtcctcgccgccctcgatacggcccggttcggcctcggtcgcgatgccgcgctcatggcagtacgccgtcagctcgcgcgtcagagccaggttctcgtccttttcgtagtggctcatatcaaccatgatgctgtcgaagccgcccaggtcagcggcatagcggatgatctcaggcgtctgggcgtggtccatgtgcacggagatgggcactttggccttctgcgccgcttcagccgcggcgtgaacgagcaacccgtcagcgtactgcacggcccaggggaacagcaggatcatggccggcgagcgcttggcctcggccgcgcgcaccgtcgccagaatcccctcgatgttgtagcagcacatgcccggcacggcgtacttgccggctgcagcggcgtcgaggatggcgagggcgcggttgccctggagtttggggtgggtgggcatgtcaattcactttaataaaatatgcctccaggtggtgtaggatcaattgttgtcagttcagttgtcaggctggagagttgtttggacaggccggaattatgtctatctaatgtggggtcagcacagatcgatcgataatctggtctcttgacggatgagacaacgcagaaccgtagtacatacctgaatcaaaaacaaagaaacgcaatcagaatgcccgagcagaaacagtcaagctgtccatcgacgacacgagacagacaggctattattctatactctggcaaataattcatcccggcagtcctcccgcatcggacaaactccgagaatgcccgccgctctaacgtgcgggctcggcagcacggcgcggcgtcgagtcgggcttctatccgagcgacagatcaggcacgaagatgaatactgtacgggggacattattatttttgagactgtgactgtttgctacttgagtactttgtacgcaagaaagtcaattctgtccagatggtgtctcgtcagatggtggttatcagtggcaatgagcgcatttacagtacaggcagtttattctatcaagacaacacatggtatattctaagcagagtgtacatacaaaaaccacctatatactgaaaatatacggaaaacacttttagatagtaatatatcaactctcccacaccttcagcacactggtacttgcctccttgccccatcccgcgcgctgcgcaagcaggaacagattcagcgcctccgtccccaggttcagcgggcagtacaggtcgcgcgcctgctgcaggatcgccgacagctcgcggaccacgtcgtcaatgctctgcgtcccggccggcgcagcgcccgtcgggatgccctcgatcatcgtcttacccagcgtggcgaacatcttgctcgcgcccgccgcgttgaccaccagctcgtagaactgctgcatgtccaccttcaggtaccgtgcaaaggcgatcgcctcggccgcggcggcgatgttggtgtacttcatcaggtctgtcaccagcttgacgccctgggcgacttcttcgggcgatttggtcacctgcacctgcgtgatcggctccgagtagtacatgcgtaccatggccgagtcgtccttcggtccccagccataaaccagcccggtgagataggtctgctcggcggtggatgagagcggcgtggggaactggtgctggcgcgcgacggacgtgatgatgccctggattcacttagcatggacttttttttttctgtgtcgattctgctgcacctaccacatccttcaggataatcgtcagcgcactcgcgcccgggttccagtcctcctccagcatgcgcggcaggcggttctcgtgcatccacgtccaggcgtccgacgtgatgatggcgtcggccgtcgtgcgggcgtccaggcccagacgcgccgccagacccatggcttcgctggcgccgagaatatggatgcccgccaacacctggtgtaccatcttcatgttgctgccggcgccgatgccgccaggcacgaggtacagcttgctcgtgtcggccatctcctgcagcaggaaccggcccttctccagggcagcgtcgctggcgccggccatgatcgagagcgtgccatcggccgcccgcttggcaccgccggacacggggctgtcgatgaagtagatgtcgtcgcgtccgcgcgccttcagctccttttcgacggattgggcgtacgtcgacgggacggttgagcagaggatgaacgtggcgccgtgggggaggactagagtctgtcagcaggtaatctaaaggataggcgtgtgaaactcacccttcgcgatgccagtctgctcattgaagagcacttcctgcacctggggcgcggacgccaccatgcagacgtagtacagactgccttcagccgactcggccaagctggagcacggcacaccgccagcttccttgaagcgctcgaccgacttggggaagacgtcgtagcccttgaccgtgtagccctgtttgaccaggtgggtggccatgccaaagcccatggccccaaggccgacgaagccaatggttggcttggacatggcgagtcgtactgtctgtcgaagctgtgaagctgtggatgtctaatcacttggattggatggcgcgcagtattcaagaaggctgaagactctgcagcagaaaagagcagccatcgacgtgctgaatttaaaggcgtctgctggacaggatgctttgcgcgctcagtccccgcgatccaatgccccgcggctctcggagcatctccgaaggcgctggcccgcagcaggtgccgatagaagagacgtacagcactgaacgaaaagaaaagaaataaaaagaaaaaggggttaaaaaagaaaaggaagaaataaataaaaaagaaaataattacaaagtacgaaaaatggctaatctcctatacttgcagcagcaattacgtagcctactgggagaaatattttagtcggatatatcgattcactttttagccaatttagccgccggcacgccgcacccccgagtcggctcgctttcggtgtggaatagaagcatggcaagcctttctgtttctccgtgagtgaatgccggcccagagggtatctatctccatatggggatcggctttccccgcgaccgaaggccggagaagattccccgtttaaagagcactctagccttccgaggttggaccggcggatggcccatcacgataattgtgacgaagaactagaccttctattagcttctagctgataagactagctagctatattccgtacaaaaccagattttcacaagttttatatgattttactttgacggaatatcccgttcgttgtttcggatagctgcgtctttattcactccagaagctgtcattacaaagcggtgaatgacctaggcatggagtttactccgtacagtcactgtcagactgccagtgaatgtaggcggtagtgacatttaagagtccttctcaccctcgttggagacactttctcttttcttcttctctgcaccaacaaaattatatatacagcgtactgtacagtactccatggagacgtcacctccagaaatctcattgatcggatgcgatggaaaagcttctaggatggggaatgaagaaccttcttgttgacccatcgacgaatgcgatataggtgttgtccgtggtgagcccaagaggttataaccagaaggatgatggcagtagaatatattaattatatttttcttcctcgacatcaggcttgatgatttgatcacaataccgttgtcaaaatatttatttgctactgggacagcagcagtcctccctgtactgtgctcccaagaactcacgacgtctctgctattttatccctttggcatggaaccttcgttgatggctgcttgcctgagttacactacggtaccgggacgtcgttcgaaaaacaagctcgaacgctccattcccacaacagacgtctcgggatatagacgaaatcatgcgacctttaaagcagctcgatgccaagctcgttgaaaagatagatctgtcgcctacaccaacagactatgcagacgaaacctatgacgcgatcaaaagaatggtcactggttgtggcctggaagatgtcggcaatagctatttgctagcgacgtctatgaagagagaagactacggtacgatggagcagtatatcaatgcttttcgacaagccgtaaagaaggcaaaccgtgttgatggtacgtatatccaacctctagctgtaacgctgttgatgctacgaggaatccaaaacaaactccctatgtgggtgactacttcccatgtgggttactgctattaaaaatgatctcagaggcgacctgagccaggaaagatgacagagattgaacttctcgagctctgtgagaaggcaatagctccttcatcatcacgatctgcgacgcaatcttcccccaatggtacgacggttgtcaaatgggtggaacagtggcttcaagggagacaacggaatgcagatggcaagtgctcattctgcgcattcggcaaacataactgcaaagaatgctattattttgttcctgaaaaacgccctgacaattgcagaccttgttcgtgtccattaagctgacaaccgtcctctgcagctgcccttgaggtgggctatctatctctcgttacgcgctccaggtcgctgtcttaagggagcgactgcaggcgtcccaaaacgcccttgcagcaagaacgggaaggacgacagcgcgaacagtcatttatgcgtatacgctatttgaacgatggcaaactgctcaaccaccctgggatcgaaaatcggaggatacccgtccagctatccgacgcgtgggtataaggactggtcgatatgagaccttacagacttatgcttcatcctcagagatacctattatgccaggagatctactggaccggtttaaggagaaatgcttgatggagagaagaatctgtacggttcgattacaatacttgaaaggactacagtgaatcctgtgaagctttctcgcttccctcttggagccggatcagcagcacaggcaaatatgaggcccgtacgatggatcttcacaacagcagtactcacgattgcatcgactgaaggaagcaatgaagccaatcgcgagggcgcgctgtagaagccgctgaggctacagccacgcctggtgcgagtgcaattgtggaaagatgaaacttaatcctgaaaatacaggttcaacagaaccaactcatgcgtggagattggtcattcccaattgcaggcagggaacttcatcaactactcgcagacgcagtcatattccagtccatgtcataacagtcgagttcttatcagatagcccatccaactggccacactatctgggagatgttcactgtttttttcatgtttctacgggacatatgcagagctgcggacctggggcctggtcagctactacccgatcagggctgatttccaaatgaagaagttgatcccagttccatgaggcttccctgcatcaccaaaaccagtgtgatgtgcggcacgaaatgcgtatggactacgctgcatggactcacaatgttgaagttttttgacctctgctgaaggctcaagaaaaattcacaggcttcttcgaaagcacttcttcgaaaacataagagacttttcatcgataagggtggaaccgtagacattgacccagagagaatgcggacacgccgacggcatctataatcattggttgatgccaatttttcttttgttcatattcgcaacgattcagatagagatgtcacagttcagcgtcacgctccgttgggcgtcgtcgaagaattcgctcttgaaaccgttgaaatcaggctccaagattacgaaaaagcaatttcttcatatgaaaggactacggccccagaggaaagggccagatcagttcaaccaatcgacatatcatttagcaggagaacatgcccaagccgtgacgctgttaaatgggaatatggaaattcagaaattcctcacaagaggagcaggatgtacatcaaattgttttctcgttcaagatgacaatgataggatacaacaaggattctggcggcaaggagactatggattgagttccgaacccaacgcgctgcgtattgaagacgatctcgcggaattcccttggggttatccggctttctgtcacctgaaactcgtgcggttttttcgggaagctggtgtcttcacttggaagttccagggtcgtttcgtgttattgtgaatgtcctttggccgtgtcaatcccggagcacaaccagagagcgtttatatcggagtttcgaagctatcctgtgtgctgtgtgtggttctattgaaagcgctatgtgatacgaaattgactacaatcaatgctacactgattctgatcttgttgaaccgtcatgtcgtatggatgtgtcagaaatcctgtaaataacagtctaataggatgttgcaaactaagcagtttcttgatatttacttcttagcgaagctccaacatgcgttctccaacaacgtataggataagtaggtatgtgtatagctctagtgttaagaaaagataaatgcacttatccaagacaagcaatattcgacgcatgactagtagcaacgctgttgtactgctagagtggtgtggtgaaggcacgatgatccagttatgacgcatcaacccggaagaaacacccgctgaattccaagcttcttttctgctaaatcaaaggaaaagcggtagttaatttaaaaggaaacccaaatggagaataaatacacaatccgctatttcttaacaaccagactgtcaagaaccttcctagagataaaggacaggtatcatctcgacaatctgcgcatatcacagcttcgcttggatctatcggaagagagcggctgctctgtcagcatcttcagcatgttctaaactctccttctcctaaaaccctaaagaaaaccggctgtctaaagtcaaacagctgagccagagccctgattgcataccagtccctcgccagcggtcatcaaccagggaaagagagttaatggcagctgcacatcgaatacaagagacttgcagcaggaattgagttcgtttcctcctgcctgaaaatggacatccgccaaccaccggtatccgcggtgctgagagtctctctttcttctcccctcttgacatgagatgcgttgatgcttgctgttgtgcggagcagtgtgtcttccttgaacgattcatatcatctggttcgattctgcaggacgcgaggacaccatccaacaagacctttgctccagccagtcaccctcaattctagctataggagcagcatcagcagggatcatcgtctctggcaaattacacagtaggtattcatatcgtcaatttgaaactactcttatcgttaattgacgtcttctgtccgctggaccgtgctaattacatttctcctcagcgcattcgttgctagcgggcactgtactcttcgttcacaaccatcggcgtgtttcactaagctcgctccctttctttccgaactcgatcccattccagtaagctgcttgtcctaagaatacaactcggtaaatgagctattatgctgacgatgtctttcaagacactccgtatcgacaattacctctgtcatggcggcggcgacccccctaccccatcatcatcgacacaattgggcggctaagcaatacggcgtcatcgtggtattctgcatcgtcttcctagtgtgcactgggatcatcactttgatcctgcaccggaaatggacggctaagaaggcggaaaagcaggcatttactgggtagtgagtcagggaggaagaagaaaagtatcgtgatggtaatggttgtcgtcttgactgggaacaccataatgattctgtcaactatttacattgtttgcatgcttgttggtataataatactctagttatgtcctttgctacacgcaagccttgctcaagggatggatcttcgaacgatatacaataccaaacattttctttttgacgagtcaactcaagtctacaactggtgaagcaaattagtgtaaacatatacgtagtgattgtaaattcgatatgactctgacaatgacggagatagccagaaatcaaaaatatgaagcattgttctgcatatacacggcctctcaccgacaaagactaacataacggcaggaatgattctacgctttttcaaccgcaaccagtcgatcgatcgatcactgctgatataaattcattgagttcgatattctgttctatcttctctgttctccagtacagcaagtccagaccagacagacagagcctttttcctctttgacaggggtaccacatctaagttgagaagggacattttgagaggtaaagaaggtattactggttcttttacttcttctctgtcaatgctaatgtagaaaacaggaacagactggctcttaaccttgcatttgtcaacctgtctatctgtttgcttccagcataaaaaggacaatgggcactccaaccctaacaccctcgttgatggatactgtcgtcaacagcgtctccagccctaccacaatgccgcattcgcatgtcaacaataccaacgtcagcgacagcgacaccagtctcaacatcgtcgagttcaaagggatagggggtggccggactagcgggggtggcgccgccgccgccgccgccgccgccgcaatcagtggcagctcagtcgtgtgcgatggttccttttatcgcctgggatggttctttcagttctgggtggttgtgggttgggtgtggagttatctgatctgattcgactgatggctttcttttcttcggaggttgcattgcatgtatcaagacttgagtctctcctgacaaccttacttacatgtatgcattaccactaggaatcaaggcttaacttgcaactacattatattcgagtatattacaaactgtgcaaatatccggtatttcgagaattgcttcatgctaaatgccacaattatagcgccatgtgtcatagatatgaggcagtgattctgatgctgacacaactgcatacagagggtttattcccctctcctgacgcacatatcccataatgacatatacactgagtcaatatggaaatataagtatctgtctgtcgaagtcgagcttcctccagtaaactcaatctcaatcttcttgccataccaggttcaccgggatattatctccctatctacttctctatctacctcaataaagcagatatattcatgtcaatcagcaggatcatgtggggtaacaattccgccgccaaaaaatattatgatcgagggtatgagataccaaaaaacgcagtagcggtagggcccaatatctaaccaactagccttagagtttacactgactaaaggtacgtgttttagacgaagtatgcctgtggctgtatatggtatgagccaaaagacccgaacgacaaaaggaagcttttggaagtcaacaaaaaagaaaattgtgggaggcacgagtgtccaaagaacccacggcggcggctaagaccggcgccagaactgaagccggtcaagaatgtcctccacaagcaatcgaacaacaggcctcgtaaccacaagggaatccagcagcagggtcatcatgatggcagaaacttagagaacaatttcagacagacagatggcccggcaagagcaggtaagaatgatggtgaccctgaccaccacaagtcgacgagagaaattaaggacctgacgcctgtaggcacatctgaagggggttatgacacggtgcagcacaatgctctcagagaccttgctctcagaaaccttactgctgctgtgaaggacatgcgtgaggagttggctatggtcaagattagtgtgaagcagaaggttgatcaagatgagaatgatactggagtgcaagaggactagggcctctacttaagggatgcacttagtgtggatgtatgatgtagggtgtgagtgagtgtgtgtgtgggagtacaatttcttcttcccttttttttttctttttttttttcatttctttccttctttccatcctctgtccctgtctgttgattaaattctgtttcacatttaggttcccccaatcggttcatgtcagagtatagaattgctgattgtaatttattgagtgaattcattttaaaatgacagatgtatacctatgaacgacagtttataagctctgattattaggaatgtttgaattcttatgtactgtgatccttgtttaatcagggtataaggtaatttataccaatgacattgaaaccgctctgccggtagctttcaatcaactctcaggtcatatatcctggaataacaaatctccagcagagcaggactcattgacctcagcaaagtgcatatggacaaccggctgacgactgacacatccggtatgacacttatgacacatgacggtgttgagtcagtatcagctgatccaatctgattcggataaatgaaaagagctcattgatgtagaatcaaagaatgctttatatagtatcgccggtaatagaaatggtctcgaatcattggcacaaagacatttggtctatatcaactggcaaagccctcttaaatcgaaggctccccgatcaaatctccctcacgcaacatcaaagacatgtccctcgagatagtgcactactgtccctgccacgcgcggaccgtactctgagacctgacagcagacgaggccgaggaactttcgctccatgacttccaatcctgccgtctgccattattccccgggcagaatgctcccgagctgaaaggaaccaccgagccactctccagcggaatgagcgtcgcaaaatacatggtagaaatcgtggaagagcgccggaagatatggcgactgctcggtgaaatcgagcagtatctggattcaccgctttaggatgccaggtcgaatctctctgacgtagagagtcaatgctgagccgagcgggtgttaggttgaaagtactgaggcgactccgggcgttgaaggagagtgcctcgaccgggtttggggttttaaatgtaacggttgaatacagacacacaatcgaaagacaaagattattgtattactagttgaagtcttgtcatctatattgagtcagatttttcccataattttgtttctgatctataattgtagtagatgatcactgtatgagtcatcatatagacagagcttccctacaaaaagaaaaataatggaatacaatgtgctgtctgtgcacatggatggacaatattcaagcatttgttcattcaagaatcagaagtggattcctcgagtccactattcacttgccacctaccaatgcgtatacgtatcaatctcccagactatacgaattgtcactttcatttcttctgagccatccacttctaataagaggtgtctatgcaaatacgacaacacatccctagctgctaaaaccatacattaaggtacagttcctgtcggatacactcatccattatccctcccctctaacgggacaactcgacgggatataaagatacaaaggcatggacttgagaagttccaacctgacggcagaagcctttagccctacgtctgtcatgtcagacctatatcaaccctctcgcccccgcatagatggcttctttcctccccagcctgggttctctggtagagttgctgtactagctaccaccacaatacgactttgtgacataaaaccaatccatccacgaacagaatgagaagtgaaggacgcaaaccggcagatatcaagaatctacccaacgacgctgcaccacaggcaaaggacagaagccaacaggtttccagccacaaccaggctgctgtcaacgatcaagttctagaggaaatcctgagtcagctgcagaccgaatgtcatcacttacaccaagtgcgcgatcgatgcaacgcctggacgacggcttatctgaaggcgatggacgaggaggagcccaatctcgatgttaacaaggcactgtttttgctgatcagtgcgcgccttttggtgaatgaatttgaatgtctggaggagcagttgaagagggagaattgccttgttgatagatggagcaagcgaggtggataacttcaatgtggatgcaatcaggaatggtactgtatgtgtgaatgggcaaggggaatggacagatggaataatagacagggtgacatggataaattgaaaaattgacaaatttggtatgaatttccttaatttatcttactttcttgccttttttttctatatttctttttctttatttagctgcgtgagaaatcatacataccaccatatgaaggtcgacttaaaatatctatccatagaaaaatattgtcttcaatacccattagaacgaaaatatccattagaatgcaaacctccgtacgatatgacacaatgggatgactcaacagtattacacagccttgagggaatgttactttcttcttcacatatcaatcaagacaagcaaaaaaagcaattaactattcagttattccgatatttagttattcatttctgacacataaaatgactccatgacttacaagcctacgaatcgagtcagcgcaatgagtaagtctgtggtactataaatgcagcacccttcatgaatagaaccattcttttagagaactatccaaccttccagactatcaagaaaataacaatttacctgcctatctacatacaatccttcttcaagaacctgctttaatcttgcctaccgtccatccaacctttccaaggacagacattcgtggtaatcatgtctgaatccaacaaccagaactagaacaagtcctccttctactacaaggacaccaccaacggagccaacaatggcgcaaagccagatcgtcttagcggcagtggtgcaaacaagaacaaggacccgggtccctatctcggcctcccacgtcgcgagtcagaccgcccagaccctcgtgagcctgcctgcaaaccccagcaatcagactggaaggactgcatcgatacaataaatgggtgtgatgcctcatacttcaagggtaaagggttagatcctcgaaaggtgttccgttcctaggcagactacttccatcgtctattatccattcactttgacggatcgtcatctccttggttatgatgccatgcatgggactcatgttcgccatctgctgagtcttgcgaggggaagggtctagagtctagcaggagaattgtcaatacaatagcgataagggattatcatctgaaggttgaatggacttgagggggagttcttcttcttctctctcttctttttcttcctttttttttctagttttttttttttcattcttttccttctttttcatttactttccttttatttgacatattctaactatttattatctttctatttacttctactttattttctttctttatttctttcttcctttttttattctcctttttttattccccctttgtcacttttctttcttacatcccctcattccctatactttgccatttcctcttcctttctctctctctctctcttttttttttttcaatttgttttttattcatgtctataacagttttgctagtttgtaggattatgtcaagctggtactggtattagtgaattaaataggaatttattgacttattacaattcatatttcatgcatatctactactactaccacaaaaaacggaaaaaaggaaataacaaagggagggagaaggagaggcacctccataatgtagttacatcaccaatttctttcaaacccaccgacccagccagcctattatccgacagagcctcattcacttatatcacgcgcaacaaggacaaagaactgccagagtggcgctaagtacagcatcaagcaggaatcaagctaatagtcatcaatcaatgttccttttacgtccgccaaggttcttcacttggctctgcatgctaatgctagggtaacatgcatatttcccgaccccgtatttgcggggacacgctgtccaaccaggaaagagaatgaaggaatttggaaattccagacatttttttttcaaggatgcgaccttgactcttttcttttcagctggagtctgtacgaattgattttgattttgttctgtgggggatgtagcagaacagaggtgcactatttccttttaccttcttctaggaaaattgtaattcgaacgctatatataggcctcactcgtggtaaaggcaaagctaaaagcaaccccgcagttcaccgcaacatgcaagtaatcttcgaaccaagaccgtcgatctcagcctttagcctgtcaacaactaggcaggatcaggctgactcaatatcctcctccgtacagtgcactgcataccaatcatttaatgctggtctcgcttaggccccgctggagaagcgtaactatgtcgatcacatcccacataaaatatgattcgatcaggcaacttctggaatacgagattgctttctagttgcggtgcacttgctgaatatgggtcatgcgccgagtatgacgggaggacagaaatgtgattcataattgcatgggggtggtaggattggtgttgttataactgttgttcgtcctgtgttgggcatactggcgggataataattagatctgctgatgtttgtacgtctttcgatgtaattaaagacagagatgatgcgaagggcatctttgctcttctgattacagatttatacacaatcatcattgttcgaaagataccttaaagcaagatgaccccacctgcgatcatcctcactcttttattgtcactcagtcaacgcaagcatggacattcgtctggcaaaacgcctcaaaccagtcctttttgagcacggctccggaacccagccctgcaagaagatcaaccacgccaagggccacgagttcagctgggatcccgaagatgacaactcgaacatgcactgtctctcgctgttccgcgacgatagctgcgcctcgcaggccgggtattcgtgccctgtctggcagaagaatgccagtttggatctgctgtcgtttaatgtctatccggagtcggggtctacgttttgacaatgtcgtcgacggccttgccaactagcaagacaagtacaccaactgctactgccacttcacagccgcagtccagttcaatagcaggtttgtccggcggcgcgattgcaggtatcgtcatcggttccgtggtcggattcttcctcattgcagggttgctgtggttcctgtatcgtcgcacgtccgtccctcctggcgaagtcgctccaactccagctccagctccagctcccgacgggggataccccccttccttttgctccttttccgcaggtcacagtaacaccattcgagaagccagcagatagcgctcgtacagtgtccgacaagaagcacgagttgcccgggagggtaaggatggacgaacagagttgagcgctgctgagccgttgcacgagctggagggagggacaggaatgcaacaaacggtgacgcattagtgttaattccaagacaagggggaggaaaaggagtaggagaggagtgaaatatgaaattcccaacgtttctgtgaaggttttgagattcgacattgttttttcttttttttttcagtgaaatggccgatacccctgtcgtctgagctatcataatttctgctgacataatgttctttttttttctttcctgcaggtatgtacggatatgacacatagatggtctcgatttcaagggaaaaaaaaaaggaaataaataagtaatgggtggacttaattgaatgactgcaaggaatgcaagaatacatgttatagtcatggccatatccatgttcatttgccatttcttcattatcatattgcatatatactatacacattagtgtcttattaacagtgtctccttcgaaaagaggccgccgttgagagaaattttctcctgacatccaggcagtctgtctgtccataatgtgatttttttttatttcccccacatccgctccgcactcgaggacagatcataatcataatcatgatagtagcgacaatgataacaatcgtgatccggcagatcccgaccggatagttcgctgaccggttcgtgtctgatctcgattgtcgtcttctggtatactttgcccatcggtggcagcgacaccatgtcctcacccaagacagcatgctctgttgagttgtcctgcctatcagcacgaaatcgattgctattgccggtagtacacccccggaatggattgagcttccatcccgcttttggagaatcagaattgggactgccaatcgcggtgatgatcgttgttagttgggtttgtgggtgatggtggtggttacgttgacagcggttgtagcgatccctcctcggttccgactccaagaggaggttctgccgtgtgaaggtgtacatgatggcgtcgacaaacccggaactcgtcatcatggcccccgacatacagaaatacgctatgctgggcgtcgatccccgcgcagtcgccatccgtccagctgccagagggagagacaacaccacgtacgccagtggataaatcaccatgtagctgaccacccgtcgcagtcgccgcaggttctcggcgtggaggctcccgaggatggtcgatgcggccatctgccgtctcaagttgatgaacatgatggtatacagcaacagcgtgccgaattccgcaaggaaaatccacaggtagtgtgtccacagtcgatccgactcgtaggattcgttgatccagcactagacaggttatcatacaactgcattgcataaaaacataatggctatcctacccacgcccccgacgggacaaagacgcctgtcccatgcgaagccagcggcacgatgacaaggaccgccagaaacagccatacaccacccacggcggtcagaaaccaccgatgttcaggctttcgaccggacctcacgaggataaaggtgtgaacggcgatagccagcacgaacaacccgctccccggatcgccaacctgcagccacaacccctgcaggaaacacgctggcgtatgggcgcggatggcatcgtgcacgatccaatacgcgcagatcagaaaggccagcgactgctgcaggtcggccagcaggaggttgtagattaagaggacgtactggttgtcgccgagatagcgtttgtagttgcccccgctccaggagatgagtcggtaggagatgaagcagaggagactgaacgtggcgatggaggagatcacggccagcactgagatggcgatgaggcctcttcgctcgatttctgagagtggagagggctcgtctcgagttgacagcagatcgcttcgaggtggattgctttggagaagttttagggcccagatcaaattcatgattgtggtgatttttcagtgacatactgctctgctagagacattcacccgactttgaaggaagaggtatgggataggacaacgatactagaagaataaaaagacgggaaaaattgatcccagtccatgccaatttcatatccgatagaggtcagattggttcacagcacctacacttacacagcagattttgatttgcacccggagtccgaacaaaacaaacaggcatggtacgttttgctggtatcggactcgtggaacgtcgcctgaaggcagctccacgattcgacttcaaaactgcgtgtcggctagagaactcgaagactttacccatgtaactgtcgcagcaacgagcacgtggattacgaacaacactggcaatatttctggcggtttccgtttatcctagccatggttggtgacgagagtcctgggttgtatgtcctgaccggcgcatttcttgtcacacaatgacaaattagcccctggcagtagcagtttcaccagtctgtcatttgattggcagggtgacactgccctgacactcttcagggcgatgcagggttaacggtggatcatgcagcttcgcgcgtcttgcgtatacgagggcgtaaagctgcataagaagcgttcttcaggctgaaaattggatcacgttgcctgaatgatttttctgatctgaggatatcaattgctacacgcaaagacaattttagttgtcgacattcgatgtgggatgatgtcaacttcacagacaacatatatatttccgcgtctccgtgtagctgatggctatggaagagtcttcaactgcaactgaacagcatgtcgggatcctgtgcaaatttcgaggtgacgaatgggatatacaggagagcaagggtacctgcaggagagcacgaggtgatgactcgacaatcaagcctgatgaatcatcaatgttgggaggcagataaacaagtcgcagggcaagaactgccgcaaattggctatgacaaccttcctaaaaggaaatgataacaacatcacattacgagaaaaaaaatcaaggggagaggagataaataaaaaaaagcccctgaaagcctctgatacggggtgccgtccctcccgcagcacccccgcggatttgttaggtaactgggacttttatgtttttggagcccagagggatcgaacgcgggttgtttttgttttcgttttttttttcttcacagactgtttaccggtactgctgcaggtgcagacctaatcactccaccattacgccccgcattcgttgacaggtagagagaaacaggcattgtatgtgcccttgggctagggggtgagtggctggtccacgcgcctaaacggccctgtgttaaccccgaggaggtcctgggatcgaaccccagtctggtgtcgatgtttccttggtttagcgactagccaacaatcagaagccctaaagacaatctgttgctccaaatggccagagtcagagccaaccctatgaagttgagatagtaacactcaattacctaaatatatacgattaccacattccaagagactcatatgggcttatttttcgttaatcctgcttcaattcagcaagcgccgtctctagcgggtctctgctaaaccaacacgaaaggctggacatgtctgcctgcgctagttgcttgtcggtcttctaacccctgtcgcagctttaaaatgaccgaatcccagccaattcaattgacaaaatccttctttcttgtcctcactgccaaatctaagcaaataacatcaatcttgttaccatattagtaaatcgataatatggctgcctctaccaacaatgcacggtctgctgctccccgtcaacagacgcctttcgacctgcctggatacaccctgcctctgaattataaaccatcggtcagaacctcatacatctaccaagtcatctccgctaagcgctgcccagcagaatggccgccctagtcgaagagatactatgttccctaattcactggattatcaagacatccaagatggctacatcgggtaattatccatgagtatgacaatgtcagcgatcggggtattgatcacatcttgccagacggttgaagacgctccgcgagattaccatgatgcagatcatgaatgccattactgataaaccggagtgggacagaaaagtagcgtatttatttccaaatatgttttgctcataatgctcaccatctttttttagatttttgacgaagaaaatcacctccaaatggtggaaagaagtccttgacagcggcagggacgtgacgcccaaaatgatggactgggttatcgaggagctgcggtacaaagcaggactcttccaggaaacgggcgctgtcagcgcgttcgacgggggtgtgatcaagtcggatatcgccatttctgacgagctgaaacatgctctgcagacggcggtgcgtccgctcgaagacatgcccgctgagcagaaagactactcatccgggctcggacatgaaagtcgtcgatttggtgcatccctcgctcttcccggtcatatatggacggagtcggatcctaaaggacgaagcgatcggcctcgatgattgcctggctcactccggcagcggagaagtgctgcctgtgccgcctgaggacgaagcaggaattcctacccgtcacgagtcttatttctggcggcgtcatcaccggcatttcgtgcctttcagtaggaaattctagtggctaccttgcgatgtggagttcacagacagtgacgagtgccacattgtctcgtacattaacaacctgcatccagccaggaatcgcgacctctacggggtcattgagaagatcctcgcccgaacgatcccattatggaacagtaccctgacggcaatgaggcgccgtgaaccaagcagaatcacatacaaaagggttgaataccatgcacgtgagcctaagcctgtggcttcacgccctgaagaatgggagaatacagaattcctcgagcgatatcgtgaatgggcacgatcccgtcaactgatcctacctgagccaggggaattcgagtcagggagcatgatgacaggagactggaaagtcgatctccgcaaggaatttcacgaaaatggcctccaagtaatcgtcaagctagcaaacattgaactgacacctgagaaaccagagtacgagggcggttcatggcatgttgaagggcagctggtaagttcttgccacccctgctcttcttgttaagtcaaactgacgactgtcagaacgagcacatctgcgccacggcactctactactactcgaacgagaacatcacgccgagcacgctctccttccgccaacgcgcggacatgggttaagggatgaatgtacgctacgaacaagcatgaatggctggaagcagtcttcggcttcggcgtcagaacaggacgagacgacggcccagtgacccaagagataggcagcgtgtcatgtctcgagggccgtctcctgacgttcccaaacatcctccagcaccgcgtctcgccattcgcattggcggaccgcaccaaacctgaccatcgcaatcgctctcttcctcgtcgacccgcacatacgcatcatttcgtctgcaaacgtgcccccgcaaagggcggattggtgggggaaagggaaaagtttttaaggagagaggtgttgagctccctccccatcgagctgcagaacatggtcatcgggaacctcgatgggttcccgatcacgatggacgaagcgaagcagtacaggctggagctgatggaggagagaagcgtggtttctcaggagcattgatgctggtcagactgacacagtaaaaaaaaaaatgagagctggcgccgagaatttctttcacggacatgcatatcaatatttggagctagttctgtagtcgtaaacatgccctggaatcagacattattcacttcggataagatgaagaggacaaaatccagcttttgcactgttccaatagggctgtggattgccactattcattcaggatcagccaaccctaacttgtaatctatcggacgaaaagactacgtctttctactgacatgccctgattcacctgattcgttttatttccattgttttatatacacatcgtcagtctcaatttttttgcgcttctgtctctttctttctgtttttcttttttcttttttcttttagtcccaatttctctttaaagctgcatcagtttaccagcgtataaatgagtcctattcaactcattgcctaacctcatacgatatcttgctgatacccttctgccgactgatcttacgcacgacaacctctccaacatcatacgtcgtgggcagatgcgtccctccgcacggataagccccgacgccttcgacctcgacgacgcgcacgaggcagtcgtccgacggggcgagagcatcagggacggcggtgcagcgcgtcctcaccgcggcctcgtcccaccagtggacgtgcactggcaagcgctgctccaccatcgcggcgactttctgctgaatcgcagccttgtgttcgccgactatcaggccctggaactcgacgaatgatgatcccggggcatggttcgccttgagctcgctcacgtcgtctagctggagcgatcacaccgccagtccgatcagatggcctgccgtgtgcagtcgggaatgatagtcgcgcttctcgctgtcgacggcctgaatgaccgtcttccctgcactgaagggctgctgcggctggtcgccgacaaagctgcctgcgtggaggatctggccgctcggcagcttgcgagccatgttgacttggaaggtgacttgcttgctgatggtgtcggacttcattgtgccggtgtcactcggctgtccgccgccttgcgggtggaagatggtctcgctggtctccaccacgtaatcatcatctgaggctgtttgaacagggcgcgctcgtcctcaggtaatgcggacagaggttggcaggagacgactgtgacagccaattctcgcaaggccgcgtcctgctggtagcgcgccaatgtgcgtggagccatcgcctggggttgtcagaggacgatttcagagcagattccagactggcggacttaccctgggacaagtcttggaagcgtggctgggatatgcctttatgctgttctacttcggctagcgatgctctagtcaagcttaagctgcggaagctaggaagaagatggcgccttttatatcgctttccccctctttcgacctccattgtggacaatctgcttattcatccatttcacgccaattgcccagcttttcgcctgtccacctcccttctgttgttcttcatgtgagacttgttatataacctatgccatgacattcgcttcttagccaacctgtaagtgccgttcgaagcggggttgttgatctaaaccgaatctctgcctgtgcatatatgaaactgaagaattaagggagggggggaagaagaccgatttggcgtatgcaaacattggtgcagttttggcacctgaacctgcaaaaaattgtaacttttttgacattaaaaaattaattatgagcccaacattatgattttctaaaaattaaaaaaaggtctagaaataatactgcttttaaatttaaaaaatacgcgaatttcaaatttatatagtaatttgaaaactaaagctttttaatttttttgaaagatattcaccatatagctttttttaattttatttatttatttatttttatttattttttttccagaaaaccataaaattaggttcataatatatgtttttaagtcaaaaaagcctacatacaaaagttagaatttttcgcagattcaggtgccaaaactgcactaattttttgcatacgttaaatttcctatatgaacacttgtgacgaaaataattttaagtatatagtttaatctagatgaccctgcttgtctataagattacagagtgctctaactcgtacatggataaatagcaacaggccaaatataaataaagaaataagagataaggaaaaaagggggggggaaaggaaaaaagagagaaagaaagaaagaaagaaagaaaggaaagctgactcgaaaaagaaagtcaaaaatggagatgactctcctactctagacatataggggaaaaaatggccgcaaagactcgacagaccactgcgagtggacatatggatcgaatcaaagcagatcaatcagatcggatcaacaacctcttccggttcttcgaccggtctcacacttttccggggatggacgaattgttcctgggtggtgcccaagtggacattaccgagggagacattgaacgcgaccttgtaccgggcctcctgcaagaaacaaaagttctggaccctgatagtcacttcctttcctgggagttctgccgtatagtcctttttcctcgtggcatggttggccaccccgaggccgtatatctcgcggtagccggcagagtcgggttcggtgtggcaatcgaatttcttctccggatcgtagattttgaggatgatgttgtcgaggtggatgggctcgtcgccggtgaacctctcgttgcagccctcgcggatggaaatcttgacgaaaaggtctgggaagggctcgtttaacactatccagtcggaggggttaaaactggcagttgaatcccttgatgataagctgatttcatagttatctgggttgtatgatatggtggacagacgggtagacgtatgttgtccgtccagacggaagtaaaagtaaaatgagcgcgtatatctgaagtagagtttctatatacgcctggcctaggatgagcgtgattaagatggtatcttcgtatccgaaattcgcaaaagaggctttctcgggctggatagaagagaagaaagaagctcaaaagacaaaaaaaaaagaacatggtgccatgctcactttcataatagaggtgcagttctgactgtttcgacaaatatatgactcgagtggcgatacggtatgactcgatatagggaagtgaagggtctgcagtcaaaccctacggttatgttgaagaagccggtgactgtcatgtcactctctatagagtttgaacggagttagtcatagtatacttactagagaagaaaggatccgaatcaaggaaatggcctgattataagtccagatgctcagagtcgatatggttccatcctcttctgtctcggataactgtttgcttgcaggtgagactgcttgaatatatcactcctcatctaatcgtttctaccaagtaaaatcacgcatatatcgcctacatacagggtgctttcatcagctctagcaagattgattcctcccaattatcctgttctgtattttatagtactatatctagttatgtgcagcacaagtacggacataattctatccctgtaaggaatcatttggcattatccacactgcctataagattgtccggaacaaacagatctaaatagcagttagataaagaattaatgagttccagtcgattgccaactagactaacatcgtgatgacatgaactgaagggaggatgaaaacaaggaggtacagatagtaatgttcattaggtaccaatttccaagggttacttactccatattccctggctgatccgacatcgtaacctcaaaaggtgccagcgtgcactggcccagaaagacagggccctccagggacaaactgatctcaagcttgaaggtccccggccacttgaaccagaagtcatcgcaatgaatgagaccacaggtctcagacacttggtgcagtctctcagaaacagggtagtgaatgtagtaaggcatatccttggcatccacctggcgatagatgactgcaccggtgctgtcacggttgtcggttgggacagacagcttaatgtccatgttgaccagctggccgttgctaattcgcactgtggagtttggcagagtatggaccttgacaacaaacaaacagtagttcatcatggtgtggacccgtgttggtctgcggtcgttccactcgaggaaaaagccggggccattctgctgtgagatgatggccgccatggtgtttgtgtggtgttgccacaatttcaattgatgagacaagagatgtattgtattggtggctactgaaaggaagaagccacagatggagaagaaaagacagcagccatctacaggggaaggcagttgatatagatcgaagtaaacggagctagtcctgatatggaaagtgatacatggcagcgtcagttttcagcgacatttgcctgcgaaatgggatatccattcatatcctaagaacaagtgatctgtgtgtctatgttgcaggatatgatgtctgaaaccattcggtggcattctattagtgttagtagcactaaggcatcaaagctaaagtccagagtgaagaatggacagaaaaatctgcagatgttgcatcaagtacctggcattaataacaaaagagaaagtgcagtttgaacttgcattggtcgagcatttctgttctttgtgctttcagtcgtttctgcctgaaggagacaagtaagagaaaaaaaaagaaaaaggagggaaagacaaatatcaaagaacgcaactaaatgaaaaaaagacgaagcaatagagtgactcaaagagagaggggagagggggaggcagagaacaaggagaaagaggagaaaagatttatagtcatatatcctccatttgtacacaattagagaagtacgattacccgtgagagatttttacccgatagtctggtagcaccatgctaacttgtatttgctttactccctttattgaaatcgctgacttgtcggtatatatcacgagtctgatccgcccattcctccgagacactgtgcaacctggaactctcgactatattgcattaccagactgtatgagcccaaggggttgtgaagaatccacatttgaataaggacaacttatgtgctatagggtattccagacggttaaaggcattgtaccttgatgtctttatacaaagtagaaaattcaatatagtaagtaggatagaaactcgaactgagaccctgcatggaaacttggtattctagaaaagtgctttttcttttgcatcttacattactctgtctaaaaaaaaaggtccattttgaataatttctatagcatcattaaagaaaaaaactaatcaatagattggaccctatgccatccatttaatttacgagaaagcctaggataataatacatgcctatttgttccatactacgttcgagcagtttcgaaattagaatttgtgcctaccaacccggctatggagatagcgtattttatctgacgcgagaatcaactcgaagttgacaggaataaaggacgatagttggagaaaatcgaaatcttgaatacacgcctgaaaaaggaaagaaagagtggtgtcatttagattcgttcatcatacgcattttctagggttaaatttgctttatgaggtaggttactctgtctcagacatgactggcatccagcacagaacctgtttttgaccttgtcaagtaagagcttccatgcacggcatgacctgtcctatataaagtggatattctacttctgttttcttcctgatcttcttgaatgtatttactatctagccttgccttggaatacaagaattcagtcagatctcccgtcgtctattccgtaggaaggtgccgccagtgcgcaccttccagactaggaagtccatggtattgcggaccagttagtcgctccttccagataaactccgtggcaagactcaactttctttactttttctacgtctgagccggcattctccaacatcaatacaacagacattcatgcagatttgatgatttccattccattcctgtttctcacttgacgctaaactgaactatgcagacgaagacgctgaaatccaaccgccaacaccacgcacaattgcaaaacacaagggtattgattgatagcagaaacagagcctattgcctatgcattcatatgagcagaccttgtccagttcagaacatatcatcatatcatgtcatgtatcatcagatcatctggtcgtgaaatgtctttgagatcatcatcacatcatatctgttgacatgaaatatatagtttgtatgtctttaccgccttcgatcacgtcgaaaatagtcgtcttcttgctcctcctcgactggtgcaggcgtgcgtcgctcgcttcgtcgcttcggacgccgtctcctgttcgaactgacgttgctcgccgaatcgtctggtgccagagacgtgtcgtcatcaattccatcgtcgtcgtccatgctgccgtcccacgcacttccattcatcgatgccggtgtacccatcctcgcgtccagattcgtcgtcaagccgcgtcgggcctgttgcgccattgccaaacctgctcctcgctcccgcagggcgcgtcgcaccgcttccgctttgcaatgcaacgcctcaaatgcgtcctcgagggcctccatgctgaggtagatgtccctctcgatctccgccaacgccgcgatctcagtctcctcgtccagagcgattggagccccaaacgccgcaggaggaggagtcgtggtgccgtatggctggctgactggtcggtaactgccgtctgtcggtccccgcgacgagccagtgaacgacgagcggcttccggggcgtggtggagcggacgcggtcatcgacgggggatagttgtcttccgctccgctgcgcagaaatccgtcgaagcgccccgagatcaagatttcccattcgtcgttactaatagccgccagcgttgccagcacattgtggatgttcggattgttgagcatgtagattgctgtctccgaatctcgaggcggagccgctagcctgtacagccgctggatagccagagaacaagcatccaaaaattgcgggcgtattcgaggtgacggtgtctccgctttcggtaccggcgtcgaggcagtaattcccaatagcgcacagaacatctcgcggcgatcgggatccagatgcgtcatgatggcaaaggtcagggtttcatcatcgacttcctctggcaggccttcttctgtctggcccagaagccacttgtcgactgcctgcttcgtcttgtgggactgacggatgtagtgctcgcgatattcctctggcacgtcgatatccaacttctgcatcggtatgtgctcctcgcccgacacaacctgatcctttatcgacgctgcgatctggaaaggcggccagctgggcaactcccgtcgccccgacacgagctccaacacttcaccccagctgaccccggagccagtctcatggttcgcgtcttgctcgcacatgagacaccgacaggtctcggatgagatgtcgcgcgcgaagacagcctccaaccggtccaacagtctgcgtgccactgatcgatatccggtagccaccgctaatgagccattcttagccatgactgtactgtaatcatccagcaaccggtggaacggctcaaaaaccctgaccaccgctgtctgaggctgcacgtattgctgtggcatgtttggagactccccagcaccgagcagatgtttcggtatccgatagttcaatccaccgttttgaagcaagtaatccactctagggatggagacaggcatttgaggcggcgggggcggagggggaggcgctccgccatggctaccaccgttgacgaccgactcattctcctcttctacaaagacttcgatcggtgattgtttgcgatatccaccatcgtcccgtttcgatgtgcgcgaccgagttcgcgagggaggcttgccctgattcggcgcaacggacgttgcatctgaatcgttggtcgactccgacaaagattcggcggcagcgggagtggaatgcgttggggatttggttttatgagtggctgcccgtctgggcaattcaaccttgtcctgtagtttcgacctggatgttttatgactggccgagcggacgggtgtcgcggagtcacgaaccctcgtcttcgctggcgtgccagtcttgctgctgactttagaaccatcctctttcttgcgacccaagctggagctcgatcgagaagggtcaaccgaagccctcctcttttccttttctctcttttcctctgtcacctttcctccgctcgagcttccttttctcgacgatctctggtctgcagtcagaggcgggctaggtggcgcggtggttcgattttcatgccgtgacgaggaccctttcggatcagtcttgccctttcccccgtcggccaggtcggtcggatctggtgtgagaatatcgattttccgatccacatcgtctctactccagacccgcctccttgctgtgggctttcgaaaggtcgggtaaggcaggctggtcctcgactcgaggaagaggccgcgcccgacggctgacccatcctctttcttgcgacccaagctggagctcgatcgagaagggtcaaccgaagccctcctctttccttttctctcttttcctcggtcacctttcctccgctcgagctcccttttctcgactatctctggtctgcagtcagaggctggcttggtggcgcggtgcttcgatattcgtgccgtgacgaggaccccttcggatcagtcttgccctttccccgtcggccaggtcggtcggatctggtgtgaggatatcgattttcctacccacatcatctctactccagactgcctccttgctgtgggctttcgaaaaggtcgggtaaggcaggctggtcctcgactcgaggaaagcggccgcgcccgaccggctgacactctcaacctctggcatcgaggaccggcgtgggcgtgggcgtggtgttcggtcgctggacgcggatgaggtggagcggacggcggttatatccgagtctcgatccctggttgaggagccgctcttccttctgtgggatgagcgatggtggcggcgttctttggttccgtcccgacttttgtcgcgatctttgactctgggggattttgtcgttgctcgttctcgctccagatcacggctgctgaggatgtttcgaagcttcgcggacatggcgcccgaggccgtatgccagtcgagagcacgtgtcaagcttcgttttctaaatcaggctcgatggtcgaaacgcgcagggaggttggatgggcgattccgggttggatggaatgacgtggggcgcacacgctggcgcctaaaccttcacctctggattgcggtgaatgagagagtggttcagcagtggagcaagctctgacgtgggcgacaaaaaggcggggacccgtttggacgatggggcagatgcctaaaaccgcccgatttgaatgtcttttccagaccgataatgataataagaacaacagctgtcccactccgcaaatactgctggaccagcggccttttcatccagacgctttacggaggaccgagtcacctgaccaggatcattgggcagatgggagaatagcattgtcctcacgtgaccagttgaattggcgatacagctttacagcagatctagataacctactagggcaccgcattgcatgaaatttcttgtccatgataaatggactaaagaattatctgttcgtttttagaatgatttcggctagatgggttatagtaaggttttttccttttctataagctatatcttgggttataatattaatattaaactatactttgcaaaagaataaatccttggcgatttagtataaacctagcctagccgtacaatagcgaatgatttttgcctgtatatagggacttggctcgatattgagaactcttagtagaggttagaaatatggcaagtctaggttgcagcgtacgcgcaaaacgacagggggacgaaggggggtccggaaactaatgaactagagctataataaagacaggaatggccctccattctctgcctatgtttgcctgcttttttaaaatactttctcgctttgtacagcaaacctgtgagtcactatttacaacgtcatcaagtgtccactatgtcatctccttacatagtttccagtatggaccatatttttgtttgcgggatttgctttcgacttgtgatttaatgtgttaataaccatgttttattctcagtcttcaccatgcttgctgttgccgtcgcattacttgcaatattcacgcctctgatcgctcccttgtggttacccaatccgtccaactcttcctatattgtggaccttggctatcaactgaaccagggttacatggttgtaagtgcatactcgtctatttaacaaggcatctgtgccctgctactgcctactgacaaaaatctcttccagagcgacaccctcgttaccttcagaaacatccgtttcgccgccgcacccctcgggcctttgcgcttcaacgctccagctcccccgccggtaaaccgcacggcagttcaaaacgcgagcgacgtcatttgcccccaagcttaccccaagtggctcactacgggcgctgtctcgccattcaccaccgacgacattccacccatcgatccgcgcacgtcggaagattgcctgttcctcgatgtgttattgcctcacggaatctgggaaacgcgtcagacgagtcgtgcgcctgtcctcgtgtggattcctgggggaggctttgacgtcggctggaaagacgccagcgggcaaggccatgggctggtgacgcgcagccagcagttcggcagccagggagtgattctcgtgtcgataaactaccgtcttggtctttttgtgagttctgccaggatttcgcttgcaccaagctctctctctatgactatagatagcgctgacaagtaagggatggatgcatggtgatggggtaacgcccaacgcgggcttgctggaccaacgctttgcccttgaatgggtccagaaacacatccatctcttcggtggcgatcccaataaggtgactatcctcggggagtcggctggtgccagctccgttgaagcccatatcaccgcgtacgggggtgccaaaggaccgtctccgtttcaaggcgccgttgcgcaaagccctttctggctgccgacttatccatccccaaactctcacgtcgaagcgatcctcagctttggaaatgtctcttcacttgccacgctccgcaaaatgtcgtctgctgatctgcagaagctgaatgcgcttctcgtcgggaattcgcgaccctttggaacttttacctttggtaattttactttctttcttcgtcaggatttctagccacgcggtgatcgacttactcaattccaggcattgttcctgacggcgactacgttcccgacctaccgggtaagctgtttcaacagcagcgcttcgatcggaacatttccgtactcaccggccacaatcgggatgagggctcgcgcttcgtgcccaacagtttagtcacggatgaagcatcctatgaagcctacctgaaatccctcatcacgcctctggctcagaatcctgccgccttgaagactatcacccaggaactgtacccgccggtcttcgacggctcccagggctacaccaaccagacggaacgtaacaacctcacttttgcggacgcgaacgttgtgtgcaatgcgcgcttcatggaccaagcgagcttcgtgacgccgacgtacgcatatgaattttccgtcccgcccgccgtccacggcgccgacttgtcgtataccttctacgactttggacaaccaccagtcgaaggggtcaacacgacggtggcggagctgctgcagcgttacattacgcgatttgcggagacgggagaccccaacggacctggattgcctttctttccgccggcaaagccaaaggcagagcctacgccgggtccgggtttgacgttgacggtccagaacctgggaagcgattttgttggtcctatgcaggatgagagtggagtagaacagttgtcagggcggtgtcgattctggcaggatgcaccatatcttttgaagtaggtgggatcatatgaatattttgaaggaatgagcgggggcgagatgtaaagatggaaagaagtaaggtttttaataaaatacgtatacaaggctttgagaacttgttttgtggttgtatggttaagtacataaaaatcaattagtatcccttgaaactcttttttttttgaaatataaaaggctccctatatctaaaaaaaatttaatgatttacccgccctttaacatttattttattttttcttcgaaaaaaaaaataattttttatgcctaaggtcacagaaacaagtaaagctgtattaaacagcaatcttctcatcatgctttttcattacatgatttgctctcaaatgatcccacctcgagttttcttgacggcattccacagttcctccgtcatctccagcacttctgcgggcaacggccctttcctgatcatggtgaccgtctcacgtatctgctcggccttgctggcaccgatgacgatgccatcttcgtccttcagcgctgagtggtgcgcgatccagcgaattgcgacctccatcggcgtcaaaccggttgccttgacatccgcatcgaattttttcatcgcactgtgcaggtcttccgccccgaacagtttctgcgcggccttgccgagcgggtggtcatctccgaagcgagtgtttgcgtgctggttattgactagcttgcctgtcaggaagcctgcagcgaggggtctgtatggtccatatggtcaatatcgtactttctctgcttcattgcaggcagcaagactagggaagcgtcacacctgaaggcgttgaacgacatgccgtgagcgcgtaaaatgggcaggagttttgtctccatgccgcgtgtgaccagattgtagtctccctgatagcagcttggtttctgccagccgtgttgctcgcacagatgaagcatcttttcaagcatttctggtgacatgttcgatacgccccactgtcaaatccgaaatccccgttgtcaggcagaattgacacaaaacgaagatactgtttcaacctacggccttgcagcgtccctgcgcaatctgctcattaaatcccttgatctgctcttccaaaggggtcgaaggatctgctcgatgcgcatacaacacgtgaacccagaatgagtgttagcgaacaaggatcttgctgattattgagacgtgcttactccctcaggcctcttcaggcgctgcaagctggcattgacggacttgtcaatagcttcagggcgcaggtcgccactgccatcgttctgcgtgttggtgtagatcttggtgtcgacaacgaagctcccactcagctcttttgtctcgccgatgagctgctccgcccggcccgggttgagtggcgggtagcgagcgcccgaatccagacggcggatacctagttcttgaagcgtctggaggagattcttgaccgattcaggatcctgaaagtcggtcaggtccatgccgaatgaagcagttccgaagataagatgaggagtcattgtcaagtagcgtcgctggctgagctccaaatctgctacggcaaaataattttcaagagttagcttcgtgccaaagcggggaggcctcgtgcttatggatgcttttccacggggtaggaagacttaagccggagctgtattattagcggcatgcgttatcccccagactgactcggtagcaggaaatgacatgacgccctcccctcagaaagcgatcgccatggtcgtcgtcctaatgctgtcgcctaattgctcagctgcatcccctgcctttaactaaagcctcctctaagccttcactacgctccccatagagctcattataaagctcagataagacctatattatatcaagccctatgggcttcataggggggcttcgcgggcactttactccgtatggggctttgggaaaattttggtatttttcaattttctcgggtatttttcatttacaatttcgaaatacagatattttacccctaaattagagggtgtcattttatcggcagtgtgcgtatatatgacatggatttcatccttattccgcccccattaatagagcttggcttagttaactagataattggctcaagcgcgaaaaaaaaaggattcattttctgagaaactaggactgcatgcaggttgcatagaatgtgcatggcactgctgtcactttcctttttggtttatgtaaccaacgaccaagtgcttcttagtgactgttaggttgctttcgtattctgcatatgcttgcctataatttgtcatagcttgtattatcttgcctacaattaaaaataatttaatcatatactcgacaatgagccctggtaaatgaactcatattctgatacatctgtctctgaacggccggcattacaaccaacccgccattggtgtctgggcaatgctatactgcgccggcagcggtagtgtagtggtaagcacacccaggcagcctccaacggcgaaagggggacctgcccatccctagcatggagatcgtgggttcgattcccaccaccggcgcatcatttaccacaaaaatgggcttatcttcctagttttcgcgcacggcgcggtctctagtttgtgtctgagtgaaaggggcctcaggcacgctagctctagggaagtgagccatacccgcgtgctagcccgtaatctagccatgtctgcgtgctggcgcgtaatccagcaatgcgaagtcaacaaggaggggttttcgctttaaaaaaaaaagcctaaccccaaatggaatagaaccagttctataccgaggaaaagggcatgggaagaccatggtagtggaagctagcagaagtgggtatcagatagggaaactggccttatccataatggaactggggtgagccagctcacggtgtatctagacctaggtctcagaaagtgttgaaacgtgtgatccctccttggaggaaccccgtctgtcatagccggaaggctctatatggacgttaaacttgattaaatagataaataaataaataatgctatactgcatcgcttaaatatattttacaaggtggaggatcaaccatatatatattacatatatatatgtatgtatgtatttgacaaaagaaatgttccaaaatgagctttgggcacacaaggtccctattgtcaaactgcccaagtagtaaaagaaaaaaaatattactgcataagaaaaacacacgcatacacacacaacacacaggtagatatggttgaatgctaacaggatattcatattttccttttcttttcgtggtatccgccttagtagatttccttctcttgctgattgagagttctacatgcaaaagggtccgcgcctacctggcgtcatgcatacttgcgacctctctactcagcagccatcctccattttgcagccgttggaagaccccttccgggtcatacgcctggctgattttccacaacttctccatgttccccgcaccgtagcttgacaggaccgcctgtccatcatatgcatcgttcatgaacctatatgccagatccgagccatgctgggacgcagacatggcaatgctttggcccatgcttcgaatgagccccatggcctgcgcatcatcctctgcagaataccactcgattgtgacgtgaacccctgtgacataaaaatgtcagttcagaacaaggtgataggcatggaggagcttacagtcctgatccaccagagtcaggttgagcggtgtgtcggatgaagcttgtactgcatttgtcgagatgggctgagagccgtaattcatggtccagcccgcggcgaacgcttgctctgcgtacgtggtaaatgccgcgtagctttcttggtacgttgcattatccacccggtgtggcagagagaccacatagtctctattaaaaaaaaaaagattaagaatgtcaactggatgcagcgcgagacagtgattgccacatacctcgacggaggagtctgcggatactgaggatcattatacatggacgacaaatccgccagagtcccgatggtcgaatcaatcatatttaccgtatgtgggatgtcgtagaacggactgaagacagacgggtactccacgggatccagatagaggaacccgacaaaggactgcggagcggtggtattctccgacagctggtagacaatattcgccttggagtcgttgctggccatctcctgatacgcgaccagcgcattgaggagctgctggttcttgtcgcgcgtatacagccgcgcctcgaaccacatcttgtcgatgggaagcgtcctgtacgtgaacgaagtcacgatgccgtagttggggcctccccctttcagcgcccacagcagctctggatggctttcctggctcgctctcacgatcgtcgagttcgccaggacgacctcggcagcaatcaccgacgctgcgctcaccccggccaggttcgaaaaccacccaatccccccgccgagcgtctgtccccctacacccgggttggggctcctggctccattgaccgagacgccggacccgttcagagcattgtatacatctccccagcgcgccccaacaccaatcgtcacggtgcttttgtccgcactcagcgtgatgttgttgaagttggccatgtcgacgagaatgccgtttctaccgacactgctgtgattgacgttgaaatcatgccctccgctccggactgcgaaggtcgtctgtgtgaaggtgataatggtcatgattcgcgccacgtcttgcgcgctttctggagacacaatacacgaagcattttgccagcaattgtcggacctacagatgcagaaatttaagaatgctgagagcttccaggaaagacgtcacgtacttttttttttatcttaccaattcgtttccgtgcgattagtatagagtgtcgactgctgtggactaatgagtttgcccttgaacactgcttgagaaatgctacacgcttcctgcgccttctccgtctcgtgggtaccgttggaagaaccccgaacagcgcgttgcaatgcgctcagtgtctcgtaatcgctgatgttaagggcatcggctagtcgctgccaaggttgaacgtcgtctctaccgacattgatcgcagagacggtgatctgatgaatgatactggtgagtattgttattattgtataaacgaacgatcgcatccttggcttctgtcgaagacctttcttaggtagagcaagaaaagaacaacagggaccaggctgtgagggaaggagtacatccgtatatagcgcagggaagtagggtaaagactagtacgcccaacgcactcctgaagcattggtagaattcgtttgatgcaacttcacttcccttcagctaaaattcagctagcttgcatgcaaattttggttattacgaagtcgtatttctcagctcggcctgtggggggcactacttatttagagctggcaacggtgccatgtaggcttccgacgccttggcggctcactagtatatgccattctgtctgcccttggaggagctgttagatctaccattgccctaaaaagtactctacgggaggggggccaaaaatctctcccttctgcttacgggaaaaaagagtccccccggtatgcacgatgatcgcattaaattaaaaagtctcctcaacgtcgaactagaatgagatgtccaaattggccaatttctttgaaaaaaaaaaaagcgtatgcatgtacatacatacagaacccctgttggagcagcaagcagccttggtggctaatttgtaattagtacttgcaacatggatagcagcaaaacagttacgccaggcagcattcaacctatgctgaaatgaatgacgaaagataagtaagtaactaactatactatgtactttgcatggattccattgcgtaaggaaataatggatgaatggaatcagtcttttttttcagacaggatttatattttgaaggacctggctaatcaatcgtggaaagactagcgattcagtagcacagactctttccccttttcctccctacgtcattgagtgattgaaaattattgcgtgcgctatcagaatatcgtttgcttgtattgtatatatatagattattgtataaggttatgcagaaacaccaaatctttgaagaaaaaaaaaggcctttcatctttgcaaagagcatacccacaatttctctttatataactgtagccgaaccaaagcttacacaaagttacgggcctctttcggtccataccctttactgggcgtgggagtcaactcgaacccctcataactgtcaggcagcttgttcctcaatcgctccctgccattcacctggctccttgacaccaaactatcttgttgaccctgctccaatgtgtcataggctgagggtctacttccccggctcgaactgacgaaatactgggatgtagcaggcgttttgggcaagcggccgaagaggcttcgagtcgtaggcaagcaggcgcatatcagcacgctggagggttcgaggacggtgaagaccacaccatcaacggatgtatctggagaggacaggttaatctctattgtgtaggacatcaataaaagcagtgacggggttgatgtactgtacatacaagtggtatcgtaagtggcaccagaatttgctcctttcagtaggggtatgcgggcaataccaatagcagtggcactatataatattaggtcgcgtctggatttctctctgagaaatgaaatgagacgtacaatccgcccaccagaaagatgagactcagcgcaaacttcttgatgaaaggaagtcgcaacttccagatcaacggctggggtagaattaaaatgcccacgtcagacacggcattaaacaaggaggtagagagactcgtcctgaaggccgggcgacactgtgtcggcacgccccagttggtgctgagagggcggcattccaggaagataatgaaccagccggccatccaccagagaacgatccatgtcgcccagaaaaagacaccgatcttgaaccacaactcgcggagggtaaaggcacgggcaaggagcgcaaggacagacagtttgccaagggccatgctccagtcatagcagacggagagggctatctcagcctatgaaatttggatcagaacaagatcattttgaaaacttttttgatgatgatgactaccttgccaatgcggatgaaattttcaggatcccgggctacccagagtaggtgccttcctaccccaaaatggccgactgaatttcatttcttagcaacttggggttgagggatgcgaccgcgtcgtctttttttcccacataccaagacatgctgagatattcaggccgatcaaagatatcttagatgttcgttagcaatgcctgagcttattattataagatcacattatcttctaccgttgttgcgagcgaaaagtagtcatccaagcctaggctcgtcctgctcactcgtcgagctaatagccggagaagcatcgatagcagcgccgcaccagtgaaaatactgcagacaacgatgaggctcgtactgcggttgtcgttgatatgagcctcttggtaggcgatttccgatggcggtaggttgtccatgttctctcttctcgtatacaatgaaaaagatgatggtcatcccagaacgcacgacactgttacaaacaaagctatcttaagaaggcgagaagaagtgatcacgcaaggtagcaaggccaacactcagggtggaggcaatggacgctcgtgagggggcgggggaggagggggccggcgctgacttggtacgatataatcttcaccagtcgaatcggcgtatagctttaccacccgaaaggccaatctagcgcttcgtttcattctgggccagtggcggttcggcagaagaccaggataccaatgccggtatattagttgagcgcttattagttatagtttaagttaaggtatctatccttatatactgcactcgcttctatatgtagaacagggcttttcatcgccgttagaagatatgacaaaggctatgaataaagatcttacttatttgaacagcaagcatattaaaacttgttgaattgagcgatatcgagaatcgagcgtttccgtggcggagatgtgaggtggcagggtatgaggatggtgaatattagtttagcatcatgcagataatcctgcagaggggccaatatgcacaaaagtcaatcactaactaacctgtttttatgtatgatgatcggcagcagaattgttggtgttgtgacggtctaaattaggtagggatgggaaaatttcaaaaaaaaaaaatacgcccatatggtaattgccgtaaatttcaaggaatttgcttaacttaataaatcatacgttttatgccgtaacgtaattcccggctgacccgatcactttcgcgctgccgcaaattctatacacaatttgaagctgtttttctcaccaaaatcaactaattattataattatagttacatcatatgatttgggcacctcctgcatgtatgcccaataatgctacagtaactgcacttcagtgactggcatgtagagggtataggaactccctctgtagtttgataagttatatgacctggagcagagttttggtcattaagctggttttgtataagatcctgcacttcttatactgaaagacctcccatatgagatatctgggctgttaactgagtatgtctttgcttctgtttcttattagctgcctgtagattgtgatactccttggccagaagtactacactatttattgccaattgacagctcttgacaagttaatctattgccacatgtgttagagttagaggactctgtgtacgatgctttaataaggctctgattgtacttgcttgatgctgtaattcaataatattataaggtgtctggggcacccaattagctaaggttggaccagcacagcttccaggtgtaggggtcttaagcagtatatcaagctgtgagatgacttatcctaggcaaaaaggaactagtccagttgctgcaaagccatttctgacattattaaacttgaaggcttctgtatgagctgctaggtatgctatgtgacggatccaattccaggcaatagagcagtttcttatcactaggagcgatctaaattacaagagactaggctgggaggagaggagaagaaggaagggagccaggtcgctagcgaggcgatttatgcaagtattctgccgtacctatacctcaccgcttttctcaccgctcacgtgacgacaggcaagttgaatcgtcacatccacccccccctcaaaatagagcctgccctgagggggagggataataggggagggtggcctgcagcaggcaggtgacacccattcagtgataacaccaaggagggcatacataatgcccaaaagccctgcgcaataaggcggtttggggcgaggaaaaggtccagaatggtcaaagaggggaattagagactagataggggcgtcgcccacgattcggggtctgtcatagccgaaaggctcggtatggacgttaaacttgaataataataataataataataatagagctataccgaagtataccactagtagtaagaagtcttactgacccccaaagtaagtatcttagtaacgatcttgatgagttgaattgagcgcgagtaaggaaagaactagatacatgaccagaattcttcttccttttataaccttgtcatcatacctcctcatcataccttccatctgggatattcctttggtagatcataccatcataccagtccgtgcttcttggtattctggtatactggtcacgtgatcttgtgcttgccctgttgctgccttgcggggtttcagtttcatcctgcattactgtgttggacagcgtcatttcttgttggtccataacagtatgtactgtgcgtgttattgccagatcccgttggctgatcaccatctgtttcccttgctggcccggcgcccttcccagggttatccatggacgtcacaagagcccttgatagttgcatcgagtagcaggcaaccttccaccatgaagaccgactgtgcaagctccctatacctttgacaaggacgaggatccagctctgctgttggatgctgggcctcgacgatggatatacgtggctatcacccttgactcccgtttgagctctgacggcacattgtctctccatacggagtactccgtccgttccgtctctcgcagcaagccaagagaggggaagccccgggtgaggctgggccgcgtgggaacgggcgatcagcgggatcgaattgctctccaatccggtgacgtgactccgcagatctagttggctatcgtggatacaatgtcgatctgcccctcatcggatgcacggcggggcgccgtatctcgtttattcgatgttaggtggagtgttcagccgcagaaccacattgtccgccttggctgacattatccgcagagcgaaaccaaaaaaaaaggaagaaggaggagaaaaaaagaaataaagaaaagaaaagaaatgaaatgaatgaaagacagtagcgacaaggaaggcttctgcacctttgcagcaccggatttcttattctttgctcgtcagaagtcgggaacgaaactgatctcactgcgttcaaaacacggagaaaccccctggagacctatttataggtctatttaggcaactgttgggtagtatcaatcgaatcctacttcgctgggcaagcgagctgacgatcggatcgaacgggacctgagcataaccaacggtcgccaaggttcctatccatgtgcgcatcgcgagcaaggccaccacctcgatggtcccttgacaagcccaatcgattcgtcagggacgaaaggcggggagtgtttccatgtttggacctcgaggaccgggatggcgctcctcgaagtaaccgacaatgatccctgccagatgctatgatataactacataacaggcacgttctttcttccactccttttctttaagtttttgtctagtgccactggtttccttgtttattcagcctacatactaagtaatctcgagtttccaagatgttgcgaaaccttgctctcctcccgcttaccttgtctgtgctgcttggccttggaagcgcgctgccggctgtcaatactgcgtccctggcgacgagagcttccagtgactcgactcctcgcaatgtgatctacatgcaaacgttccagtacaaaaacggcacgcaggtgtccctcttgccgctcctggagcaagacaccaaagtcacccatgtcatcctggcggcccttcacatcaatcagaatccgggagatatcacgttgaatgaccatccccctagcgatagctactacgacttcctctggccggaagtcaagcagcttcaacaggctggagtcaaggtcatgatgatgatgggcggtgctgctgcaggcagctaccagcgtctcgcttcggacgtcagtcctctttgtctcttctcccgattgctcacccagatagctgaccgtcaggaacagtttaactcctactacccacccctcctgcaagtccttaaagaccactccattgacggcctcgacctcgacatcgaagaggacgtgcctctcacgggccctcttcagctcctccggcagctcaactccgacctgggtcattctcacttccgcgccggtggcatgtgccttgacgacaaacggtgccaacatcaacaacttgagttacttcgatctggataaccaggcgacccaacggcaagctcatcaactggtacaatgcgcaggcctacaacggctggggcgacgcgggctctcccgacacatacaccaacatcatcaattctggatgggctgctagccgcgtcgtgttaggcgtacccgattcgcagaacgacggatctggttgggtgtcgctccagaccctgtccggcgtcatctcgactctccgaaaggactactcggactttggtggcgtctttggctgggagtacttcgacgcgggcagcaacgacaacctgagcgacccgtgggactgggtcaagacgattggcagcgacttgaccggcgccctgtcgaagagtgcctcggcgctggtttgcaagcctcccaagcccgttacgccgttcgagccgcagatgaccgagcttacggccaagggtgtctctttcggcgatgccctcgtctcgctcaacaagaccggtggagacctgggtcgcgcaaaggcgatgctgcacttggaataaagcgcattcgcttctcatatgtctctttgtccattgtgaccttaatggggtattacaacatgatgttttattcaagttggcatttctaaaggcctattcagtaataactactgtaattagtcctaatctgagggacaaatgtaggtatggagtaaaaggttgcaaatttgagcgttgaaactgactacaatgacatatatggtgggaacagttcaacgttgtttctatcttatattgtatcattatcgttgtgaatgaacgtgattagaccatgttgctgctgtcgtttactggcaaacagactgactggcaatgttggagcaagccttgttgatcgcagaacaatgcgctgatggatatatacatatatatatttcagcaacacaaatatcgctcccgtggatgcaagccgaacattctcacatcggtcagcggaagcatgcccctcgctattagtggtgatgaagcatcctgctgttgatctgaatagaaggcatcttttgggaagaacggctttccatgtagcagctaatacgcggcacagagagaactgacaacaacgctgcaggaacggtcctcgaagccggagaaccagcacagtcattgatcccaaggacacttccgtgacgagattgacggccacgcaaataggatgcccttgctatggcgccaaagggaagtacaccaagctatcttccaactatttcccgagcacgaagccgtcaatgtgaaacgcgaaattggaaagatcaggcaggttcctgcccggctgcgtgcaaagaccacggccaatttgtccagctctggctggagtgacactaggtttctgtgaatcaagatatggaagtcgagattctctgtggtaggcaagacaaaatgggcatttggtaatcgagcggatgttggagccgaatgaggaagaaaaggatgtgctaaccagtcaacaagcaattaaattaggagctaaattacagttttacgagtaatatctaactctgttctatctatacaaaactcctagctctgaaaatcaagtacggcaaagccaactcattccctcgaccctcctgttcaagttcgctcaccacttggacagctttgcccagttttcagccagcctgaaataatctctgctccactgatcaagcatcctgcttacatccttctgaaacgagtcaattctcgcctctacgtcttccacccagtcaggagactctgaggcactcagtgaacgcgactccgactccgatccgaaatccgacatatcatcgtctctttccactctctcaaccaccctctcaaccatcctctctcttctactggatcgccattgctcaggaacagcggtggcagctcgctgttctgacatgtacggcacgtcgtcctcctcccgcgcctttctcttttgacatccacaacttgtccgtggtctttcctcgcgtcgtggagatggagaccggcgctctccagagtcggtattggcgtcaaggtcaactgggaagtctctggaacttccttcggtgtccagttggtcgcggaactcgagccattcgtccatcaaacacctgaaaacatctttcttgttcgttctccgacgcgcacgactcgggtccttcctttcttccataatctccttccggcgctgtgtttcccagcgctccaccagcttcttgggatcctcaattcgtctccccaactgattttttacccgatacgcgcacttctgccagaagtgctctttgggataggcatggttggcaaattgacaacgtcgatctagtacccgctgcataatccagacagtatcatcgtatgtcaaggagcgcgagtcgtcagaggccatctcgacaaggtctgtgatggacaggggtggacgctaattagcgacgtgatacggttctgatttagaacggtctcgacgatcgaaggtctgttttggatgacgaggtcgaatcaagttggagaaccggccgcaagcaggcttggaaagtttcgggccagagaagagaaagagggaagaagttgacagttatttgctgagcttgaaagaagcaatgaacaggaaaggcaatgaggaagccgatgagtgaatgagtaagaaaaaaagattgcgctgctgggagatacctccattgcttaagtgctctctctggtcgagtgttcgtgaggttcgaagacgcgtctcgctagctcgttcacgctcgaaccctctttacgtgtctgcgactattggccattgtaaccgttttcgacctagagcgacgccattcgactgctaaatgatcgtcccactcacgcgtcgccgtaagtcgcgtcgagagggcgtgcataaaagctggtgggtaatttataatagcgcgaacgaagactttgggtcctgactatcattgtacggagtactccttactctgcacggagtagcctacggagtaggtagttgatatactcggtatagaagctggttgacagcagcgcggatggttacttcctaggtaggaagtccggaaagttcccaagtttccgctgagcccattggctccgcgctcagcccctgcagcttgtcagctgtcactgtcagccacctggacccaccggtgcggaggattcgtgctcaccgccaaaagcagcgtgctagagcgtgtcaagattttgaagcctatcaaagacactatcgattcatcgaaaagcccaatgagatttttgcccttgccagctgacccagtcgactgtcgtaccagcatcagatcacttgctccgatccaacttctcgaagaatacctaaaacgacgtagggattgcatggaggctgccagagccagaagctgctgaggtataaacctgtgcgcagatgctgttgccattgccttggccagtagatgatggatcacgtgagattgttccgattggaaatgagcttttttgcatgaaaccacttccacaacgccttttgacttttcccttgttaatgagtctcgttacgtagttagctagctgccttgatcccttcggcgttctgcgtcctagccatcatgtattcagctctgttggacttagccagcacggaaataatattaattcgccagggcccgtctggaagactcgatgaaaacaagagacaaaaaaaaagaattgtatccgaacaaccatggagtgctccggtggagatacaggtcttgtggtgcacactgcggatcccataaaaggtttccggcgtgaagtcggcaatgcaaaagtcactgagtccataattacagaggcccgtacttgcgcatcagggcgttccagtacgattgacaaattccagcgcatgtcaccaaaagaatgcgattcaaatagtaaagcggggagatacgaaaatacaaagtaggaacttttcttgattacaatatcagtacagcaactacctaggtagcggtaactttgtccgagaaggaacaagtagcggatctcacacatctatatatatatatatccagctgccatttcctcttcacgacggaaacgtggaaatggcaccccatggctgggaccatcatttacaacacaaacacggcagacatggcgagtgcgcccagggttagccaaatcggggtctggagacgctcggccatgctctttgagctggtggctgtggccgatgccgcagtaccagtggcagacgggttgctcgacttggacaacggctgcccgcacaggccggatccgttcaggttgaaggtcgggaagaagacgcgcggctggcccttgtccatcgggacgacgatggtgccgttctccccggccacgacggtcgtcttgcactccgtcacctcggtcaggttcgtgcccgggtcggccgcaccaggcacactcagctggtatgctccgccattgctaccctggttcgacaacaccgcgacgatctgcacgccgttcgggcctttgcgcgtcgcgtacgtcgacccgtccgtgtagaggatctggctcaagttggtgacgtagttgctgtcgaccgagatggcgtgattccgcagcttgttcagcgacgccgtcagagtgtatagaggcgccgacttgttgtagttggtcggccacaacgcctggcggttgtacggcgagtagttgccagtcaggtgctgctcttgaccgtagtagactttggggattccatcggccaagatggtgaaggccagtgcgttcttagccagctggaaaaaaaaaacaagtcagtttcacgaaatcagggcaagagaagggggactgaccgccaggtcctccgtaaacgaggcaaaccgcgggttgtcttggttttcaataaaggtcgccaagtactgcgtcttcggacaggcctgtcgcatcgaacccaccatcgacacgagatcggccatctttccggccgtgaatgcctctttgatggtgtagtagagcgggtagttctccagtccttccgtcaaattctggtaattgcaggtgaactgtgcgtcgccgtcgtccacttcggccatggcatagacacccgcgctcttgaggaagggctggaagaagctatactcgatctgcttggcgccgtccacacggatgccgtcgatgttgtaggtgccgaccagatccttgatccactggttgagtgtgttggcgatgttggggtccgtggtcttcagccgcggtgtggccacgccctcgtaacccagccagcagttttggaactcggtctggttgttccagtcaatgatcgggcagtacggagtgaagtccttcgagctgttgaagggtacaaacaccgagtagtcaatcggaattgtcgagctcatgttggcgttgccaatatcgtaggccatctcgtttgcgacaacgtccaccaagaggtacatgccgcgcttgtgcagttccgaagcgaggttcttgagatcatccggcgacccaaagtgcggattcaactcgtagaaattctgcggccagtatccgtgataggcctcgccgtagatggtatcctgaggcagattttcgtttatgggcgagatctggacggcggtaaagcccatgtcctggatgtagtcaagctggtccaccaaacctgcccagttaccaccgcagtatttggtgatgttgcagggagcattctgatctgtcgaccgtgcaaaccggtcggtgatgacctggtagatggaccgctgcgcccactcatcgggcgtcgcggcctgggagcatcctgccagaccggcgaggaccaccgcgatagacgttgggaatttcatgatggcggcgcgatacgagaatcaagtgagcggagcggatccgatggggtagagataagaacgagatcgcaggcttggcgagtcccgattaatcaaaattcaaacgattgactgttggcggctcaagcgaatgtcagcccggagcgactggctcaggacatgagagaacgacagaatcatgcaaacgagcgaggacgcagatgtgtgaaatgcagactagaagaggacgaagcagccagcgaagaagaggaaaaggaggagaaagcaggccctggaagccgtgtgcgaaagatgacgcggttgcgaacaggcccgagtcagccagcgcaatgtgattgctgcgacggctcccgcagccacaggttatcgtcgacttgtcccaatcatcgccagcgatcagcgttgctgcccggctttgctggagggacggtgcgtgtgagaacgttgccggggggcggccggcagccgctctcataggctgatccgggcgattcgtgcagcaatgccaaggtgaaggtcgcgatgccacagcatcgtggctgcggccccttgccatggctgtggactagccaggaatccggatgggcccgctgagttgtgattgcggggagcgataagctcgcaggaagaaggttccagcaacgaattgtctcgtcgagtcgacgtggtgcgatcgtcggccaaagccctcgctcctcattagttcaatatcatcgctgctttgcaagagagtactccgtacgtggaatttggaagagcacgctctcaatctgctgtgataaggagggcaggcaagctcacctgctccaggaacgttaccttcgcccccagcctggctgagacatggatggagcccggcgcggcgctatcccgttttgggcggacaaggaaccacgggacggagagttacatcgccagcgtccatctccgccagtcagtgcccgcggatcgactggatccatcgaaaaaatttgccagcagtcggggccatcatcatcacagtcgtcctcgtgtcgtcgagtgactcgagtctagaccagaacctgctagcacggcccattccccgcatctttcctcggcatgtcctccgtgcgatccctgggaatttgattttggaggggagaaaaagaacgaaaggcaaggcgcaaggagggggaagaaagtcaaagttatgagacaaaaacgccggtgtcatatcgatttcgtcgactaactcttgttctctatgcgcagggccaatacgactgtgatcttgggattggatctgaagaaagaccccgatgtgttggaagaacggagcgaggaaattgaatttccttccgccgttcttgcctgtcgctcacacagactgctatatcgaagaccgaaggccacgaggtcactgctaatccggtcaattgtcatggctctcatgccatcgggatagtcggcattgtaagattgaaccagaagctgggttccgtcataagcaccttcacaggatccgtacccttgtgcctccccccttgcttcgaatactggtaaagagcgagtcatcgatgcaaaagaggcccattacgctgttgcaaaggtattacaggccacctgttggctgcaactgtctgttgttcagtccaagacaggttgttgctcttccttccgcatccagtgactttacctgaggtcgcagaacgtaatcaccttcttccccctatatgctgaacctggacttgcgatctgcacttcgaagtgaaccagtgactgctgtctgtaaggcactggccattgacggtctcgagcaaaaaaaaacgatagttattacggctgtgccactagtgacaaagtgttgtcgctgtctctgttattttgacgatttaggaacaatcggcttctgaatggagtgaacggagaaatggtgatatgaacgtttctaagagatcgaaaactagaaccggtagactgcaggatttcggctcttgaagcgagtttagtgaaacagtacaagaaagacaaaatccaaacgagaaacaaatgcttctatggccagccataatgcggtgatttgtcgggtcaagcgagtgtcagataacgtttgaacactgaaacaaagataccggcccctccgagtgataaccaacacattgttgaaggtatcagcatgccatacaacacattatcaaaccttcaggtcaatcagttcctcgtggagacccttgggctctttaagggtctcaacgattgttcgaatcctaggctgtcgacatgtactgagaacattgaacacagcccaagagccctgcaggttatgcttctgcgggccacacaaatattaatcaacgctgcctggatttgatggcgtccaattaggttgcctgtcaaattgccaagcgtttggtccggaccaatgacggcactgcccgaagcgcagctgccaagccacgtgcataggagcttccttggcggtgattcggggcttcttggcaagccaacgcagtcaaaaagggagaagagagtagattagacctctgcgttcgcatttcacgatcccggcacgaacggtagtttagcctcagccctatcgagtccggaaccaaaggcttgggacgatttcaatagtccaagatgtgcgctaaaaaactttagattagatgccgggcagttgataagcggccattcgttacgaggcgtaaatggatgagaaagccctgccagcccccagatacctggttctcgttcttaccgaaccgttgaaaaatatcttccacctacatagacgtagtaggcatgctgaagccatgcgcgactacacctgaaaaggaagctggcgcagattaggccccttccctgaatagtagatagactcttggatatactggttcacgttgatacctctctagtatcaaagagtctcttacaatccactggatgtcgtgatgcaggctcacctgacagacatcgagctaaaattttatcttcatagagaggagatatttgataaattaataatatgaatattgctagcccaagaagatatgatcatactcatacaccagcccaatgccgaagatgaaccagacactcatacaacacacccatgcatcgtcacctatctctccagcgcaagtattcagagcctgatcgagtgctgatgatattcgatcactctggttcaggaggatcttcagaatcgaaagtgatcaactttggtagatgaccgtagcaggcactgtaacctacgatcccgtggtacggtacgctcttgtcgtcgaggtcatactctaaaggtacctcaaattttggaccggtcgggaatttaatttccttccgaaatatggcctcatgagtgggacagctatacttgttgtctatagtagatccaagcactaggtcgattcgacatggcgcgtcaaaataatcacggaacttgttcttggtgctgatcacatttatcaacgcttgacggaaatccttgtcatcaatctcaggatggatgctgcagaggattgccgcaaatggcgagacaattgcaatcgccgaaccgccatggaggtccactgtttgcagctgctgcactgcactgaatttcgcagtgcaaatcttgtcaaagtcaacaagtacaggccactgatctgaaaccatatcaggcaccttgggtgcgccctcgggcttgtcaggaacctcgctgacaaaaccggcgaccattcgtttctccttttctatgtgaaatggagacatcttcgttgccaactgctgaaatagctctgggttttatatctagaaagcaaagagatataggaattagtgttgtgttttatttaaggaacactcatcaaagaaatgtaaggtaaaggggatcgatccatcgacggcagcacataaccatagttgtcgagtctggcgagcccaaaccagatagttttgtgctactcgataaacaggaatgcttaccgagttaggtcgacaagtttaaaggcgtatatgtatgtatgataacactaggtagatatgaaattcgttgaaagcaggccgggatcggtttaatatgcccaaatgggctttcctgggatgtaggaagaaagaagaaataatgacgcgaaacgaagcaattcccggtttatatatcattgctctatactgactcagttctgagtcaaagaggaatgggaaactagacctacattgcctcgaatcaaaagaaaaaaaaaaagtgctattaacgagcaggcgtattcactgtgaagaatagggtccattatggatccccccagatctccgccattttgcttctgttttgtcgcgacgtagctgatttcttatctttgccaaagaatcatctacgatgagagtggtagagataccctggggcgaggatgattatgaaaagtcagaggctatgcaccgaacgcaccaaacctacgtaccaatggtaagagaagccttgccggaaggaaaggaggcgggaagaaagaaaggaataagacggggggaaaaattactcagaagtcaaagggccacattttgctaagtcagtgctaaaggtctgatatggatcactggatccttcccccgcccccaacggaaggatctaggatcgacttattgactcattaataaggcaacgaatctccatccgcacctaagacatcaggctcccccagacgtcctagccaccggacctttggctgaccaagaggccactacatactattctcggcacatgttgaattcacgtttccagctccctcttgtcctcgagatacgttctaatacaaccccaatgaaaacgacttaattaaagatagaatacttaggcaggcgagcggttaaatgcaggtcccgctctgccaagttcgccgagatatcagggttgggggctagagtgtggtccggtgcaataggagaatatgtacattgatcaaccatcattcttgccttatgagagaggcatcagataatttatttatttagacgaaaaagggttataaaggcacgtttcccttcctcgctgtgcccatcatcatcaaccaaactccagcgaacaccttcagatatcaacaattacatcctacctacgtattgcacctaccacctctttcttatcgttcaattcttttcctaatattcaccaacacaatgaagactcccactgctacgctcatagctattgcaacctttctcctctcaatcggtggcacaatggcggctcctgcctcggttgcggctgttgaggtccgggatacgatccagcactgcccggagggtgtagttcactgtttgccggtgaaaaactgatcataggtacgcttttccttttccttttccttttgcttcggaaggaactgattttaattttgcattcattctaggtggcatgcagtcctgcaaattaatattcgctcgctttgagattagtggcgaattcggaaaagcaaactctcatgtataatatgccttctttcaaatttctatctgtgacatattttctctagtgttcgcttttgcaaatggattgacttcagtttccataacaatcgaagtatgtaacgctcctccattatagaaagcttccgtggttggccagaacacagtagtgacttggattcgtggcgaagggcatctttatgaattttgacttgttaacagaaacttcaagactggatgcggccacacctttggattgtagttagagctatcaaacagattcagtgccatttgatagactgtcacatttataaccatgtaaagagatagaattgtcttccactcttatattcacaaagacaatgattcctcttatcacactgcctgcttcaggacgcatcttcacagtcgtgcctgagagcagggacagccagtctggttagaacttaaacaaatcccagactccactactcagtttcatcctctcttaggaactcaatctaggacattctcttcacatcctggtctcatgtctctatctttcaatgtctgcctactgccaccatgccatacaagcaccagcagagcaatgatgatgaatcagatgacaatgtgtcaggaacactgttgtaaccggccgagatcggtccctgaatttcgggttctttgatactccgtaactaactaagttagtttaactaacgtaatccaccaccgagctggtcacaccaccgagctggtcagccacaacaccaacaccgagtttttgactattactaccaccaccacccaccaccacctaatggccgatatatctagggaggaacgtcttcaattggcccttcaggcctataaaaagggccaatttccatcaatccaaaaggctgcagatgcatttgacgtgcctaaaagcaccttaataacacgtgtcagtgggactacttctcgcaaagattcaatcgccaattgtcgaaaattgacagagactgaagagaatacactttcaacatggattatctggtttgcgcagcactcaatcatctttggcttaggcggcaagtgtagagaaccaagctgtcgaatccagcaaataattgccttctcttgctggtcatctagtgccttattacgcgcgatatgagctgtttttggtggccgacccttgaagcgttcgcgaagccgtccgcgaggcacatcgaattctcgcgccaacgcagagatattcggtttttttttgacatgaagcctttcgtaaagcttcctcgattcgggatttaattttgtctggcgattttggcattgtggtaaggcataaaattgagaaaattgtaaaaattgtccattgtggtgaaaatgtccgttgtggtgggacgcaccaacacgggaagtgttggcgcgtcagggggcacggctactctatactactttaggacttgacatgtaagatgccctatcatctgcagtatgttgcctcgttcatgcaagccagttgccttggatttcactctcgactagccttgtggtaaatcgtttactgccatggagactacattgactatatttttgggttcagatcatccccttatgtggccatgaccattgaattttcagttgattcacaactggttcttcaatagtcgggaggaatatgcttcacaactccgattgcgtcactacgtgccttgctaggcggttattttgctgcagcttttgatgctcgaccgaacctttgctatgaactcacagagaatattacgggcccaagccactcctttcaagtaatctgtacccatggattctgtataacatggtcgattgattacactggacaaatatacgtcaaggtgtatgcgttttccagtctcaaagaacgaggctcgcctccaatcgaccgagctgcgaagtttgaagccattgagtgggcaggtgcttcttggcccatgcaacttgtacagcatcatagaccttggctacggaaattttccttcaaacctgtcgaatttttccagcagcgatgcccatgacaattccaatccctctagcgccatgaacgaaagcgaggaagttccatggacaagccgaattccaaagcgcaatgtcaagctactcagtgagagaggtgcgtcacaactttctcttaagagagatggacgagcaagtccggaggtcaattattgcggatcgtggcgcaaaatgcgaaccaaagcagtggcctcgcatcacgaggagtgtggatgtgtggggcaactatctggtgtggtaatcggatgccaaggacggtggggtagtggggttgcggccttctgtttaatattagcacaaagtcttctatggtaattggctgtcaacagaactggagctctatggacggcccgatggcggagagtctgaatgtggatctcgtcaaaccaattgagcggattgactggtagtattcctgttatgcactttggctgtaccaataaccaggttttgcacaatcgagatgaaaatggatatccccagaggctcccttcagggtggtgtatgttgaacgcatgaagtggaagtgctcacatggcctgtccccgcctccatccctggcttaccttaattacctattgaaaggccacactgccttccaacagggatttgcaaaggtcgcttgaaaatgagccaatgagaaatttgccaacagagggcgcttgggctcttgcttgagtgatcttcgaatgagaggtcacaacggaccactctttttgaccggcgagcctccaactagcccagaggccctggtagttatcatggctcgccaacccccccccccccccccctcccgggtatttcgcctagtaggcgtaccttgttgatcagtctcaaggtatctatctctccaagaacgcatcaggacatcttacttgatacggagtggatcagccaaacggggcggcacggatcccaccccgcactcccgccgtgatgcctttccatccctggccgcccgggcaggtgactggaacagcgtcaccaaaggcccacgcggctgtcatttgaccccgatagctgtagtctatgatgtgtcagacactcgttcccatcatccccatgggaaagcacataaatacagcgttctcgccacaacttaattgagaaaaagtggaatcttcactgagctaacgcacgtaccaattccgtcaaccgcttcgatccatctcttctcgacgacttgccggggccatggcaaccacgatttcatatattccacctagtctgtcgtcgtccttgactgattccattaccaccataaaggcagccgcgcacccgccagacaatatctcgagcacctcagagaaaaagacaaaccactgggtgctctatctccccacttcgcacaacacgtcggttcgcctcgatttgagcccctctgggcccggggctgcccctgcatgcctgctcgtgagtcgtctcaactatacaatttcgacaaatgtcgtgaagacatgcgacatcactgtccgcgccgggacgactgtcaagacgatcgtggatactatcaagtcagccaattacgatcgatataagttcaccgaggggggttttggcttcatcggataccgcttatgaaaggcgcggattttgtctggagcgcgcttaaaatccgtccatggctgccacggaggagcagcattccattcgtcccagtccccaacatatgttgctttgtattgcacacctaggcgcttcgtctgtcgacagtcgactacttccaatacttcccattcgtcatgcggttcctcgtcgtcgtctccgttaatcagaaaagctggttgaggcttttggcgttggcccggatagggcttatcgggtgcgaggtgtaacttccacgggtggaagattggggtaagaccagcctttttcagatgatccggtaactctacttcgtaagccttattgtcaatgactctcgtaatcctccatgggcccgcattcttaaggcctagggatttgctgggtcgttcggcagcgaagtgcctagcatcgacaaatactctatccccaactctatattctgggtgtggctgccggtgtttatttgcgtgtcgctcgtattcctcctggacccatgccaactgatctcttagccattcgtttatctcctcattgcgcttgatgatgcggtctgcagtctctacctcagccttccctcgcccctcataggtccctggcggttcagcaccacttcgagggtgatatccgaagtcagcaaagaacgggctcatcccagtcgctgagtggtcactgttattcccgacaaactccgcttcgggcaggtagtctacccagtcatcctgtaggtagtcgacgtagttccggagatacgtcttgatggctttatttatgatctcggtctggccatcagtctctgcatgctgggctgacgacagctttactttgatgcctcgccgttgacatagtcgcttccataggtgactgatgaactgaggccctcggtctgagacaatagaggcgggtaaaccccgtgtgcaaaagactctccggttcacagcctcataaacctcttcaacttccaaagtcatcaacggttcaaatattcgtcccttgccaagccggtctactactgtcatgatatgattgtacgttcgtcccttccggtggcacggtggcagttcggtgatgaaatccattgagatatctagccaccgtcgttgtgggactggcaatggttttaataggccctgcttgagtactgtgcgagccttagctctgcggcagtcgtgacagttatctgcgtactgtttgcagtcctccttcatgcctggccagaaatatcctctcagaaggctgcgatacatgctcttcgcgcctgggtgacctgctgttctgacagtgtgatgagcttcaaatatcatgcgccggagatcggtgtcgtttgggatcattaagcgtttgcccagccatatcttgttgtctcgtacttcaatatctcccatagagagcttgattccgctggcaattatgtgagggggtaggcggcggtcacccctttgctttgcctcgatgatatctttcatttgctggtcgttctcatatgcgctggatactagtatgtccaggtctcggggaacatcctcattctcctcttcagtggcctcagttggggactctcacgtcgttctcgagccgcaacggtctacccgacccacgtctctattccctcagagacaagacctacgtggcgaagggctctccctgaacgacaacacacaaggttctctcacacaggactctgttgtcacagacacaataatgagggtgcttcactgagtaacaacaacaacaacgactaggtcaggggcaacgcctactaaagctataccagaggtataccaatagtagtaagatgtcttactgaccctcctagtaagtatcttagtaacaatgggaaattgagttggattgagtgagagataaagaagaactagatacatgatggcaatgatcgtccttatatccttctcttggtatatccttgatatattgttggtagatgtttggtatatgatatcgtcttggcatctatctctcatataccattcatataccacatgtcttggtaatcacgtgacctgagttccttcaaggttaaggtgttggttcaggtgtcaccttccctgtttcattaggtgccaatcggcttgttccataacaggatgttgcggagccagtgcagctgaaacagcttgtggtgagggttgcttttttttaattatttttgtttttgttttggttttggacagttagaaagttccagacaaagggagctgttacgcgctgggtccaaccgtagtcgtcgatacttagcaatggtggttagggaaggatcaaggagtcttcctgactctatgtcgttcacgagcacgcgacgatctaaccgatccgggtctcctcactcgagacaacggcctaactggcgaagggctcttcctcgaacgacctatctcgcagacgtgatggggtctcacagggacacaacaagaatgcttaaggaacaataacgactaggtcagaggcaacgcctactagagctataccgaagtataccactagtagtaagaagtcttactgacccccaaagtaagtatcttagtaacagaatgataattggaattgagcgcgagtaaggaaagactagatacatgatgaatgatcatccttttatgcttttcctccagcatgttacttcccctcactgtgacatgttcgtcctatcctgaatattatcgagcatgctgatctcgctgccttgccatgtcgaacatgtcagcatgtcacttctgccatgctgccatgctggtcacgtgattctgccttgtttcctaaccccgcgagttgcttgtttcattctgcatcgctgtgttggacagcgcctcattctgttggttcgtaacaggagcgtgaaaggggaagaaagagcatgggaggccttcattagtatttattccctatcatgttgagtggctcgaagtcccggctcccaaatcaggaaagtgcagtgatagcttgcaccctgttcctagagctgtatcctacatcccagctacttagattgagccaatacagttagtctgcatagcgttgttcctccctccttgacatcaagatgaactcttaggctgcaccaggcagcacacctatcagataagcagataagaggcgtgcattagttggttggagggcagggcattggaccctgcgccaggtatggagatacatttactttttatacaaggctatttagttttaattgcattacgcgcgttatacaggtacccacccattttttttgtttaaatggtcggctccacttcccgatacatagcaactgccccacctgaccggggtgccgatcactcgctatgctagtatcagggttttaaggaaactttaaacgatacagtacaggtccacctgtcccaggttcctactagtagtaataataagctgtgatgtggagattacagtttcaccagttgtaggttccccacccacagctgtatggtgggaggtaggggaggggagttgccaagtcacatgacaccaaggtacatacatagtacacattgcgtgagtttgaattgctgcggtcctgtagcatgtccaaacttgattggctgcccggcttgcaatgcaaagtcatggggagaactcatctttggataatccaaacctcctttagaatgatacattctcatgtcaacgacttgtttttgagcgaaaaaatggatctcttatcagcattaaagactctgcggaatgcgccagatgacgctctccgaatttacaggcacgagattgcctctgttttaatagaagttgagaaacgattgaggagagtggtttccgctacggattctcaatctaaagtcttgcccatgatctgctgcttttgccaacagtcatcttcatccacgactcatgaagatgaacctgcatcaggtagctcagaatattctatccgtcagtcagatgacaatgacccagataacaatcccgacgacgacccagacaacgacgctggcattgggagttcggacggagcacaaacacgaatttccataaatttacagtcctgtccatcacaacatagaaacattcctgataatgctcttagcgatgcatccaccccggcaccagagcggccgtataaactggttgaagcgttgacaaaagtcctgccttggttatgggaattcaaagaaaatgaacctgtcagcattatccgaaggaagcgattgcgattgcataagagagacagaagactggatgatatccagcgtgtcgaaggcaataggtccccaaaggaagaggacaagttgttcagaggacttgctcagagatcgctggctctccaatttacacgaacgcaagagactgaacaaaagactgaacaactatcaaaagtggataagctgtgtcagatcctttcttctcggaaatttgatcgaaaagccctatatgaaaagcgagggggagttgttcagaaatacatcagaagaatgaatccaaacatcgccagtgacgacatagctcttaccatccgagccatcaatgctggaatcaaacagctggtgattgaacgactacttaaagaacggctcatggcaatgcgacgatcaaacagtacaagtggagtatctgctgttacagctttgactatcagagccttcagggaactgcacttggaggaaatacccaacttcattgacgtcttgttcctcgagtcatccgtggtggagctgccagtcaagccgtccacttcagaccagtcaagcactactccccttcattcttctggacatcatagttgttttatcacaatggttcgacaaggttcagcgcaggtaagatagtgagggggatgccgattctgaagagcaactgccagatattcagcaacctgtcccgaagcgcgtttgtctcgcgcctctcaggttgaatgacagagcactagatatcttaatccaatcaccacatcaggccccagaaggcgggggacgtgacatacagcggcttccccaccaggctacagcttttgtcggcaacaacgacactcttgaatctcgcggaacggctgcatcacccgatgaccctgtacggataaatgaaccatcgccatttgatgatgaccatgatgaatctcgagttgattccggccagcagttggagacttctcctcattcacaacatcgcccagccgacaactgcggtgttactcttcccggagacgacagtgacattgtgcagggtcacaacgcaactctccatcctgaagaacaagaagctgctcgaacgctctcccatatccatgacttgacgtttaattccacagagactgcattggaccggaacccgacaagagaggcagtcgctattgagagatctcgcagactaccgacccattattcaggggcttccttttcggacagcagctataccagcccgcaagtatgtcacagcatacagaaccaagctgaacagacagacgggagcgcatctgttccatatcagactacaatttcgccgggccagcaagaagggaatcagcttccgtcgatgagcagcacatctcaagcgtcagacagcccttggcacgatttcccctatcaagcagagcatcggcattataatacataccaatcaaccagtgataatgtgaactccacggaatcatgtaaaaacacagttcccgagtctcaagttgattccggccagcagttggaggatgctcgtcattcactgcagcaagagaattatgaccgaccagtcgcttcaatggttgatccgcaaagcgcttgcaactctcagatgctgaatttgcaacctttccccaattctgatccgggttggctctttcccaattcagatccgggctgggtagatagcgacttacattttccttttccaaattgggacactacttttttctacagttaattgtctattaagactaatgatgtagcacatgaatgaattcatcatgcgtatccagactcttaagcattgttcgtgttctcatcctttcctgactcaagagacgctgacacagcctcgcaaagagcaacacctccaccagatttaatgtattcaatagtcatattcgccgctaggaacaggacgtcccacggtccgagattaaccggtatggattctgctcgctttatctctccagccgtcatacgatgtgatcgcgggacaatttcaaagaacccatttccagaactgagaccatcgcgcgtagcagctctgtatatcagcaccgttccaggtggaccgggaacgaaacgtcctagtcggtttttgtcgaatagcatgagtcttgtatcaccgattttcttagctttataataggagcaaccgaggtacttttggaaccaatcttcgtcgggtaactgtggaagtcagcgaagtcttctacctcattgaaaaccaacatacccttaagccatagcgcatgagttcccggcatttgtcgccacatcgcctcggcgaagatgattcggtagaagagatctccttttcaacctcgataagaagatcatcgggaggtgtatccccagaaacgatgagaaaaccggtgtcattctgcatcgtcgtctcaggtgtgatattctgtgttgaaaataatagagggacttaaaaatttggcggggttgtaggagggaggcaaggaccaagccacacgtggctgaaaatagccacgtaaagccacaaggacaagaaatgcaactacctacgttttcaaggttggaaaatggaggtgactttaaataaagactctggaggagcctttaataggacaaggttacaaatagccttctatttgcacgccgcgctgaaggacgcttggtgacgacattaatagcggggctcgaatttgcctagtcaggcagcgacgtcaggcggagatgtcacaacaacagcaaccagtttccagctagcgaccggaagacgtggtcacgtgcaagcagacatgtccatccagaccaggtttgctgtcccctaggttctcaatacccaacaatgagggttgtcattctgcatcgtcgtctcaggtgtgatattctgtgttgaaaataatagagggacttaaaaatttggcggggttgtaggtgggaggcaaggaccaagccacacgtggctgaaaatagccacgtaaagccacaaggacaagaaatgcagctacctacgtcttcaaggttggaaaatggagaaggtgactttaaataaaggctctggaggagcctttaataggacaaggtcacaaatagccttctatttgcacgccgcgctgaaggacgcttggtaacgacattaatagcggggctcgaatttgcctagtcaggcagcgacgtcaggcggagatgtcaacaacagcaaccagtttccagctagcgaccggaggacgtggtcacgtgcaagcagacgtgtcaccaggtttgctgtcccctgggttctcaatacccaacaacgagggatctgaaccgcgcacgggatatgttttgtcgagagagttgggagaatatatttctcagtgattttggagccttgagaccgactgcacatatggtcaagacatagagacatgtcttagatgccacttggttatggcctatgacttggtatgagaatagccagcagaagaggagatatggaagcaggaatgaatgcatcatgttagttgtgctcatactgaaacaatttactgggttcatgttgctgacccctattagcgtgatactagatgctcgcctcagttttactgttgtcaaaggagttgcaattaccttggcttttgcgagcaaagaggaattggcgaggtgggcaaaaataaaactgccagattcagaaccgagaaagaagtgtgagatgtcaactgaaagaatcggcacaaattacgagtttgaaggaggaggagacagagagcgctgcagtgcagctaattgactgataatgcagaaaaattccaactacaactaatgggttcaaactcaactgtgatgtgtcttgggtggttctttgcatgtggcagcatagttgcaaccttcccagatggcacaacatcacgaagcagagaagcagatccagaaaacatactataagaagatattcctaatttcatcagcacttcgtctttagctgagactttgggcaacatcagagggatgatattctggagaaagtgtcgccacggacttgccaggatccctgggggttctgccatgcaattcccggccctgtacgcccgttctctagccgtgagccatcggaccataaggtgagccctgggcgggccctctgggctgccgggattgcttcttccattggcaagaccttgatctggcctgggaatggtccggccggtgtccacatagtttcttcgaagccctcagatgggtcgactggcagggtctctgccagtcgccgtgccaggtgctgccctagtgaccatgggccccgactgctggtttctgcccatgcccgatcccttagtggctgctcgccaggctgagcatgctgatccccctcccagagagtcattgggagaattcgttttgctaggtgatcttgtcgtatctggcttgcttttctctaataaccccaaatttgattctttgtttaattacttgaactcattctcagtaaagtcgtgtggtaaatttagatacctgtatttgacgagttagggaaagattgtgcaggaaacattgcagactcctttttaataatgagtaaacagcaaacagcgtcactcgtgaactcgatttccaacccacgtctagtaattattagcatttaaatagcagaggtcctttcaagtgcaaaacatttagagtttgctgacgtctggttgctgcgagccgatttcttttcagcactgatccggtttggttactgcgagcaggttttgggcctggatcacattagtgtgatcaatcaaccagatataaagtgtttaagacaggagtagtgttgacttcaggatccctacctaaagaacttctgcaccttacaaagagtcactttggtgttacttgtcagctggccccttttattagagttcactatttgttgccatggacaaacgtggaaaccgcacgacacgcctccctgaggacttaaaagatatcgagctatcagacaccattgcgaccactgacgaagcaaagcaatctcggctggatccgggtaaggatagtcttgcacagcgccgttttcctataaggcttgatccagagtcattcagacaaaggacgcttcaagcaaagaagttccaaggcaattacaagagattttggaatatcaagcaggctggtccggggatagtcgccattaaagatgtcgaaccgctaccgatcgtcttgatcaaggaacgcgaaactactaaatttattaaaacccaattaaaaaaggtatcacataagaacgtgttaagcctcctggactttttccacgactcggataaggttactctggtgtacgagtacgaacattcagctgttgcactggccagattatctaatactccaaatgtggtattcagcgaaggggacattgccactgtgtgccgggaagttctcaatggtcttcattatatacattcagagctgaaaatcatccatgggtctctaaattgcattaatgttctcctgacgatgacagcagaggtcaagattggtgagcagcttatcctcgagaactaagacttagttgactgactacctctagcaaatataggagatagcatgctgagtgggaaaacattgagagaccgtcaatgtgacatcaaggcagtgggagatattgcaagtgaccttagcgatcctccagcaaggccagaaggatatggctcagttcgtagagtgcccgagaaggccacgtacatgacgcgtcaatttattgagaagacaaccggggcaacaatccaagagctgttggaggtaagtactaatctgtgacaaaatttgggacgagaatactaatttaatattcatttgtaaaataaaagcatgattttatattggcggccacaccttctggctcttggagcctaacacctcacattttgaaagctgttccatttggtgccaaatttggagattacgttggtgaagcttctgtgtaaacagtctccaaaatggtaactgatttataaactcgaccacctggatcgggagactgaactgattataaaaaaagatagtgcagtccaaatacacttactagtctagaaagacttggaagtctgaaaagacttaaagtatatagagactcagtagtctaaaaaaagtcagcagtctgaagagacccgtagtctagaaagaccctgcagtctgaagacactaacactctgaagagactaacacatctgaagggacttaacactctgaagagactaacacatctgaagggacttaacagtctgaagagactcagcagtctgaagagactcgacagtctgaagagactcagcagtctgaagagactcgacagtctgaagagactcagcagtctgaagagactcagcagtctgaagagacttaaagtctagactctgtagtccaaaaagtgagcagtccaaagagacctacagtctagagagacccagcagtctgaagagactcagaagtctcaagggacctgtagcctggattcggtagtctgaagagacccataatctaaaaaggacttggcagtctaagggagatgattacagacctgtcgccgaacaggaatggctcgcagcaaaacggatcgcaatgaaatgtgctgcagtataagtttgtcctggctcacaattagacgtcaattcaaattaatagtctgacattcagcttgcaaaatggattcctcctccttcaatgcacttggccaaaggacggaccaaattattcaagaaagattacgtttttatcgaggctgcgcaaaagtggaattgcgccatttggtgtttgatagtgacgatgtgctgggttctcgaccactagataggagcaacgtgggaagattggtcaatattttcaacatcgaagggtgttctcatttcgaaccagagcaccgtgtggctgcaatcatcagcgaggataccttgaatagaagtcttttacgctccaatacaacacaagaagctcttcttgatgttgtcgacccgcccatgctggtttttgaagacaataccaaactactgtgtccctatggcaaacatcgtctcaaagccgcagaggagtacggagagggttggtggctagtggaattatatctagatggtaccgttacctttgagggagacctgcataatacatgctaactgagctgaaagctctgcctcctgaggcgttgacccaactaagagaggaatcctccaatgcgcggaatttcaaagatggtgagatatatcggatctacagacagtatgagcttcttaacgacactacacaagcaagaaagtggtgggcaaagtttgagtccgacgatcgaaggaaggactttcgacgactgctcagtaacagcctccttcgcgaaggattcgaccggctgctgccctacattgggatctgggacccgttaaagtcaacccaagttgaacgaattttgggaatgcgatgccatgaggtacatctgggctgcctactcaaagttctttcctcaacactgaccaaaacgacttaggaggtctatcactatttagacaacatttaccagatttggtcgactctcttctctaaggaaaaggcgtcctatgttgatcccacttctgtacggctcttggagggccttatgccgcagtattcccacagcgaccaaaatcgaatcatggagctgatggaatctggacagctctttcctctcgttcctggggtagaagaaaggagagcgcttttggatcgattgcttgcgacctctggaagaattctctcactcaacactctaatacatgacacactttatctggagcggcctgcaagggcatttcgcagccttctccctcaaaagttcaagggatcgctgaaacatgccatgctaagacagcatcaaccccggggaacccctggacagtgtgaaatacagatttcggaacatgaattcaaaactgtgcaggtttgggggagctctttcttgctcgttatgatgcaactgtggctgttcgctctaagacatttcgtttcgccgcacatggaacgaaaatcaaaacaggaagcagcagactggccaatagagcctcgatctctaagcaagatggcaatcttggctgacagatttggttttacttcagataagatgaaggagcttcgacaaacagacttcgatgaagcaactatagaacactttctgcgcgccatctgcagggaagagttttacatggtcgaagatagcaagatcaggttaatggcactacgattcaaggaatatttgcggaacttgtctaggcaccaagaaaagccacgaggcacaccagtgttttccacggatgatcctgataaaatggcccatcgcagatacaatagcccccgtttggacgaatatgagagggacagaacgtacctctttatcgagcatatatacagtccaagtcagcctccaggacagtatccaacttcctttgccgtcaccagagaaatcttcttctcgtttttcgggagagaacccccctacacaatactatcacaaagggatgcctctgtgccacctgcccctgctcaagccgaagacgcagacagtcaacaggccaatgaaagcacaactagtccgcaacctacagcgacgggcaatactccagtacaggacaacgaaggaggtgaaagaatagcaacgcactctgagttaccggagattgtagtgtcagaacctgttgatctcgaacctcatcctccaggtactcctgatcgtttgatggaaggggttgagtttgatccaccattggcacacgggttcgaggatcacacgtgcaaggccccattggagaaaagagcagagatatctcttcatcgaagcgcaacccaggtccttgatatgtggcgtgagtccgataacagagacctcattgtgctttatatgtttgagtcccgaagatatatcaagtttcttgctcagggtggactgaacttacagttgaccttggatgatctcgggcgagatcactatttccttactatcaaaggggatgaggtggaggttccggaaaatgtatatgagggtgctttagaaaagcgacttgtcttggttggcagaaagaatgcccggagccgtggaatcagggacggatatggacaaatctccctaagtgagttgcgaaaatacttgtccgcgtatgatgtccggactggaaagaggaaacttgaagaagacgataattatccagagccagacaaaccgtcatcttcccggttgaggatcttatgatgttatagtttgtattttagcaacagctattcaattgctgtctttgtctttgtggccaggcgtccgttgtcttcctaatgccatgagatcctaacattccaggcatgccctcgaacaccatgtaatgcttaataagagaatggctattgttgtttgtccctacaatggatagttctgcattaagacgatttcgacaccttgctatatagtcgagatattatttactcagacctacatccgagaaacgtcatgctgaccaacacagctggatccgatgagcaaagaccagtcatctttatcgattttggtgacgctcgtttccatgtgacaaaatttcacagaacttacatctctctttttgctacggtggcatgaagcacatcgccttatctctacctttgattttgactcctgggtcgactgggactggcagtcctggcttgaggaagagtatggacacaccgccgcgtcgataacggaagaaatgcgagattggtttctttcggactcccttctcaatcccctgctaccgtggaactactgatgaaggggctgacctcgcagagatcctatcctgcatcatccccagtttgtcgtcagtttggagttgtgttggatttgaaaaccaggttaccagtaacatccgacccaatcaaggttcccatttttcgaaactcggcaactcttccctcgctggcacgaggtgataaggcagatgtgagtgtcctgccacttggcttcgttggacgtcttataatttgggagactagtttcctgtagaataaataaccaagccttatatgaagagacctggtttcatgtaatcaggcgccgataggaggttagtctctcgtatctatctattcatcctgaattttaccccacatgcgttcaactcattcagctaactataaactcttatggagtcaattcacttcagcgattgcattgattctcagctaacattctgaactatcatagataacactgagatagataacttccacgggcccagcccgctgacttggaaaagcgtttcgcaaaaaaaaatcacgacaaaagaaattgcaagcgaacggattgctggatcgatattggccaagttggtaaaatatcaaattatatcttttctcctgccagcattgtctcgagttggcggtcacttttgattcatcattttcagcatcatttctttcatttcggatatatcacttcgtagtaatttcaagtcgttcacctcccgacggaggctggtaacttcctccttgattgtcttgtcacagctcggcgctgcgaatcaagacagaaaatcgataacggccttagtctccatggtgaaactcgatggtctggaggaaaggaattcagagagcctggtggaatgttacaaatggagacgaggaatccatgagcagggacgaccttttcttcttgaacatgtattgtcaaatacaggctccattccgtcaagataccaaatccagaagtgtattttgggatgccacggtttccttttcttacttctcgttctggttccttcaaaaccagctcgcaccaggaaagatttttgtctccaatgctcatctgggagtttcttttgcagtttttggcccctttcaaaataccttccgcgggaggcgaaatagcaagcaattacttagatccgcacacctcgcgccacttaaaagattagtgtatctctcggcaaattaggggttttgtataggctgaagggcttcaattcttcattcctcgttgttgttgttgtctctctcccttaagttgagagatttttctaagcctcactagttgactagtcctaattgggtgcgaacgggccggtagagagctgactaatgcctgaggtacctacttctccgacagtatccaattatctcataacaggtcagcaagactgttgccgataattgtttgccaaattatgctaatgctggtgctcgtaagggagcggatgccacctagtctttgtgtatcgaccgagattgattttattttaagaagcacccaaggtcgtttttaccggtacagctcttgggtaccacctttctgtttcgaccatcttggtgtgaccaagccaaggcgagaatttatgatccacagacgtcattcctcacctgcgggttattttaaagagaccctttattgtagacatgtcgagttggttcttttcaagccctgatccaagttgtcggccttggtgtaggaatccggagcgaggtagaagcctacctacctaagaagataggcagtgaagcgtacctatcacctacccgataacagctaaatcgtattcgtttcgttcgaactaattacaataaacagtttggatcgcagtgaaaaccggctctggtttctacagaaacgcgaggtcgcactatcgaagattcgttcatttggagtaatacacaaggacgtggcatggcgcaacgtgctgtggaacgaggaaactaacagcgccattatgatcgatttcgaggacgctattctgacactgacgcagcagtctcggagtcgacatccgaatgctcagaagccacaaagtgggaaatctctgctaagtctgtatagaggtccaagccggcagcctctgaatcaagtatctggaaatcatttcaaccggaaggggaatcacaagcctgggaatgactccgacgacgagaagttgctagtcccatcagtgaggccttgaatagcacccataggttgctgaatccaactccctggagcagaatctcttctaccttacttcttttttggttagtttcttccagaattttatttgcaagaccgcgctgtaaactatggattgtaataatctcatagttaactacattcctcagatcgattacataataatactgatgtcatctccctgagtttaacaggaagcccaatagtgttgttagtcatcgtcctgcaaaatattacattaacgtgaggcaatacatacaatggaggtgaaagcccaaggcaatagcttttagtagagtcaggagagggtagagatttgtgctcaatgatttagttgtattgggtgccaaactaacttatctaggaatctagcttacataatctatgactaagcgaggtcgacccagggcaggtggcacaggaagtccatatgctccaacagaaaatgtgttggaaaggggtgtattgtgtgttcattggtgggtccggtggacccgacgtctaactagttagttagaaaatgtgatacgtctcaaccgaacaactccgcaccgagtatgaccaaaacaaagaacaccgctctgaagctacgatatgcctatcagatgcccaagatgtctataagaagagaagaaattcacctagatagacagacaagttgaacaagaacaatgagagatgagattacagaattggggaaccgatagagcctagagaatccctgacatctttcttctaccgcgtcttattctcagaaagccaagagtgcaatcaaccagatcttatcttgccatatcttctgtgaatcaataattcttatcacactttaagaatacttcgatcatccaagagtgcggcactcacggactcgaagccggtttggttgatcatctgaccttcctatcatcgtaatctacatagagcaacggatctttcgggttggtgctctatacgacgacggaagacaatggcatgttgtcaattctcctgcgtgactcccgcgtgagaacatcgcttatccctaaaaaacgaaggctgactcgatctcgacagtgttgttagtcatcatcatcccgaaatcttaggttaactatcaatagttaccttaactaactattatggcttaagtaaggaacagcctcgccgagattctcgacgaggctgagtgtcaagcttgcttggcgtcttggcgtccctagcgttcccagacgcttaatcatgctgaaagcagttagtctatcacgtgaccatagaccggatagcgaccggggtcggatatgaggagacgaagagacgagataatctacatagagcaacggatctttcgggttggtgctctatacgacgacggaagacaatggcatgttgtcaattctcctgcgtgactcccgcgtgagaacatcgcttatccctaaaaacgaaggctgactcgatctcgacagtgttgttagtcatcatcatcccgaaatcttaggttaactatcaatagttaccttaactaactattatggcttaagtaaggaacagcctcgccgagattctcgacgaggctgagtgtcaagcttgcttggcgtcttggcgtccctagcgttcccagacgcttaatcatgctgaaagcagttagtctatcacgtgaccatagaccggatagcgaccggggtcggatatgaggagacgaagagacgagactatggggttggtacgcccttgtggttgtttacaacatatggttaacctggttacacgacaaagcccaacttggtcgtcttccgtcaggtcgcctttctgctgctcaagctgctttttgtgttgggttcgagagaaagttgcgagtactttccaaggagacccacatagactagcgttctattggttgcggagaaaagatgttcagtaccgacctgagacctttggccatgatgatggccaataggacattggggaacagctagttgggacttaaagcgaattgagactgaagacaagacatcgttgcctgatctgcttccttcacacaaagcttttaaggtcagccttcctccgtcctggagaaccactccatcgatatgtatgtaagggccgggatagcccaaatgccataagacttcgtaagtgcagatgaaatttcgcgatggttctgttcattgacagtttcttagtgaatttcttgttaacaaccccgagaaacgacgctttgccttgcttgcttgcggttctccctagccaatctctaccgaagcctaagatcaccagttatcactgttgtcatgccacctccctttcccctaggtggatacaaaatccaggagatcactcgaacccagcttttggatgcaatacattgcgctccagttgtccatgaacaggaaggtgcagttttagtacgagttcatgaatctgccgtgctaaaatacggtaatggagtgtccctagccgaggcgagaaatataagatttgttcgtaagagaacaaggatacgagtgcccactatttttgatgcatgggaagagcgatctgagatatacaatggcgaggaacaagtggtgggctaccttctgatggagtttatcgacggtaaccccttgtgtgacatctggccaacactcaccaacgaggtccggaactccatctttgcccaaattgccgactatctccgtgcaattcataccatcgagatggaaagaccagggccagtcggtggtggcgtctcgcgcgggccgctctttactgattacggcgctgggccattcctgactgctcagcacatggaagattggtttaatgagcgtctcctcgtgtgcaaagaattcaatcgtgtttcgtatgaccaccctggattctccggcaaattccgcaagcttgttatgtgccacatggacgtcgctcctcgcaacatgatacttgatcgtgatggaaagatttggctactcgactgggcccagtcgggtggatatcctgcgctgtttgaaacagccgcgctcctgagaactggtaatcgcgaatttacacaagggctattgaaatatattgatgattaccaagaggaagcaaaggatttgctgaagattggttttgctttgacgacggcagcatggactaaaccatctggccatgtaccgcagataacttggagtaacaggacatagagtatcaatccgacgatttgcatccttgactgttaatggccctatagtagggattcttctgcgagatttccgtgagtttggagcgcgcgcgcgctctagatgttgagagatatcgctttgaagttgggctgtcaattcggctgtttgtatagcgctttgaaagactcggtcaagacggcgcgtaaagctcttgtcaaggttagggctttcattgacaaacttatccagcttttgaatgctccgtcgcagtgtacgaattgtctgaggaggagaattggttgagctagatggaattgatggtgttttgtcccgtatatttagaaccggagatggagaccttgcgttggctagaatgtcgagtgctttcgaaggattccagggatatatcccccgatcaataaaggcgtttcggattgtacgttgtttgaatgtatcgcagcgaagtttagggatatcacgaagaaagtcggccttgtctatcgtagagatcccccattgtatattctcattgtttttcttgcgaaaatagtgtttaaaggcctggaagggctgaccatcgagcggctgaacgagatgagcagtcagtatctcctcgaacacggccctatgggaccgcaccgactctcaatgccaacgatgagcctccgctcaacctcaggaaacacagacaatggacatccgaggaggtcgatcttctggtgaagttaaggaaggaacagaagctaccatggtccgaggttgcaaagggctttgcggaacaatttccagggaggacccaagggtctatccaagtatattggtgtacgaaattgaaggatcgacactaaacggaccgagcaaggcgaaggtctatactctgtcaaagactgaagaaagtcaatagaatgtacagaaccacgttcgtatgtacaggatgtagggagtctgcactgcttgattttctctgtgccttgtcatctatacgtgagaaaacgttccgtggaaacatcatccgcgaggccattcgtgagaccggattagttccatatcaaccagaggttattttacaaaaaactccgccaatttgagcagcggccagagacccttgataataacgaatcatccccaagcatctcaacgcctcaatcggctcgcaaaatacagaaaattggcactcaaatcttatatttgttgcctgactatgctatattccatcgcctggttgaacgccttgtaaaaggtgcaatcgcgacagcgcatcttgcaaagcaacttgaggaagatctaaacaacactaaagcagttgaacaagcacgacgagagcgtcaaaatgtactccgcatggtttgtcagtcgggaggcgtcttatatgcccatcaagcgcgtcggatttataagaaacgcgatgaggatgaggttcaaaaagcgacaagaggcgttagagcaggctcaagagcaggatcttcgaagacgcaaaaagttagcaaaacggcttgcgattgattgcaaaaacacagaaaggttcttatagatagatcgaaggcttctcgtattgagaatcaataaatttttattgttgtggtgttgatatttgcaatcgattttttataatatagaaattttggcttctgtgaggaggctaaaccattttgggtttagaccccctgggcacgggtacttgttgggagtgccggaggtcggcaagaatgaaccaatcaatcaatcacattctagctttggcacgtgccacgaatccccaactctgaatcctgcgggatggctatcccattcgagaacaaacgacccaccaacgacatttcatccaatcgtgcgagacatcatagtggtcggataaatgtggaagcgacaggacctgaatgcagggcttaatatcaatggctgcggagtaatttgcctcgaactccaactcatcgaacgcataccccgcggcggacaagacaattttcgtgattgagaagaggagaagaagcaagttatgcgcatatcctgccgtacaagccagcagctatcacctattcccttttattggtagccccagtgcggtacattcccgatctgcttccacactactcatgtaaagcgcagggcagagtggtgagcaataacactagaggcaacatattagcatcactagaagaccgtgtaaggtctgcatacatagagccgcgtttcaccaatgtagctgcatgtacgaaattttagttccgagcttgacaacagttcaaaatagttatcctattaaaatcaccttgaggggtacgtagccatatttattttcatcttgtgccaaatccccccccccccaaatcccccggaccctgtcttaagattggctagttgagagaataaaggggtttctctagtcgtacctggattggatatcggaacttggtgttcgcgaaagcgctttttcatctagtccttgtattgcctgttctgaaggcggccgtacgctgataggctgttctagagggcagtcttgtttagacgagggtcatacgagactcctaaaaaaaggccgggggttgaaatgaagagagaccgaaaaagggcagaaatagagtaaaagaaacaaggaaattgaaagagggcaaaaattaaggtgcccacaaaagaaacgaaaagaaaagaaaaggagcgaacacttggtattcgctgggaaaaattgaaagcaggttaatgaatttcgggtataaaactctatttgtgcattgctagaggtattagctgtgaatagtgataaatgacttatgagttacaattaaaccaagggtcgttcagaatttccctcgctgacgccctggtggacggctcaaaccgcagcaattttccaataatttgccccagcttagctatatctccctttgtcaagtcttcgttccgctcaccatcaaaatacatgtcttctagccactcttgcaatgcgggtcctgagatttcggcggcagctttgtcatccatcgtcttccataagtcttgccatctctcaggtagagcatcagttgccatctctcgcatttgaccgacgaggatcgtgggtgttatcaagaagctgtcgaagggcggctgaccgacgaaaagctcaaagagctaacaagcctgtcagtattgttttaaataacttttagcttctggcaatcttactcaccatacagcccatgctccataaatccacacgataatccaaccggtctccaaatataacttcaggtgccctgactggtagtggtgtgtgaagagtttgaggaatagttgtgtgcaaaaaggattcaccaaagtcaacaatcttgattgaattcgacgacggccaagaatgtgtccagtatgaggcaggcctgacaatgtactctggtatgccaggctccagagcttttccgtcgctccttcggacatgcccaatttctggtttccctaggatctcaataaattccccctcagatatattgttcatacaaggtatcgtaaaagctagattgcgagtatggatgtctatattaggtgataactattagacattaattccaaaggacaaagatataagcatgacccacctccatgtccaatattctgctagtgcaaaacgtcaagtccaaaaagagtctgttttgcaatagtcttggcgagctgtccaggaagcctgccatcgggaaagtgtgcatcaattgtgtcagggatactaggccctagaagctcgaatacgaggcatttatgtgttccgttcggaccctctaaatcgaagtcatcaagcatgcgtacgacgtgtcgagggctggggtgtatagatgccaatttcttcatgacatggagttctcgattctcttcatcattccctctttcagaaacggagatcttgacagcaacataggtctcgtctctaggaataagttagtttcatttaactagaagtgagctcagcaactgcaatttgaacaacctgcaatctcttgcagcccaaactgttgagtagcctccccaccctaatttgtgcagtatcttgtatcttttgttattcaaaaaacttcccaacgtgatagggtggtagccacctttttgatagcggtgaagaggctcagcgtcaatggtagaggtatacgggaattgatccatccgaggcagtgttgaaaaggaggtgaagttagaagtgagggacagctgcgggatgctccaggatgcgacagcacgtcttgaaatcatttgagggattgcgctgcaagcatagtaattatactcgaatgtatatttgagtgtgatcttttcgaggctggaaatgatctgacacttggcttgagccatccgtggccagcggcaacatgtcacagcgtggtccaatcacgtggtttctggacgcgcctaacaaaatttcccagcggcaactccttgtagctattggtcataataaaatagatcaatgaaccgagactgaaaatatcatcctcaaaacggggagtaacatcccagttgcaatctggatgtcgaaaatcgagttgctgaatatgcagacggctctgaaccggacagagaagcaccagcaaagtcggagatcttcagattaaggccagagtctaacaagaagtttcttggcgagacatcacagtgaacaacatcaacagaatgaaggatttgaagtccttcagctgcttgcttggcccatctgagacggagctcagatgttattgcgtgatgatttttctctgatataatctcgaagtatttccattgtccatgtattcgatcgtaagacaacaaaggtatactataaatatatattataattaaaaattaaacctaattatttattattttcttacaggtctattttaataaaataaaattaattagttattgatttagtacttgaaaaggtcatatactaaaaaattatataatgtttaaaaatagaaaaattaatattttttagtaaatattaagagtataattatattattatattaaaattaaattagtacttttatttaaatacttattttttagtaggtattttagtctacttagatataggcttagattaggataaatatatacctattatatacctaaaatactagtacctactttatttatatattagtatatagtaactaaaactaaaataatttttactcatttattttctttttagtatattcttaatatatatttagtatattttctgaatcttctaaaaaaaaattaacttttctctatttctagtatatattttatatttattatgtatatatgaagaatacttactatatcttatataaaggctagttttctaaatcttaaaatcttaaatactataaaccttttattatataggtattttataataagtatctctctaagttatactttatatatattaactataaataggccttatttataatctaaatactagataggtactactcttctattaggcagcttaagaagtaaggataatatataatatatactagtaagatactatatatatactaagctaattctttctaggatattagctaaaactactagtaaaaaccaattaatattataacttagatatattttaggtactattaatagttatatatatagaaaaataattttaatccttattaaacatatattaagtttattctagttatgatataataattaatagtaaggaaatatataaggttatattcttaaattagctaataataagttcttaatatacttatattaagtatgtacttagtatactaataaagagctagctttagtaacatatctctatagagtattataatataaatataataatagatttagataatacttagtatatactaataagattttagtttagaaccttaatataactaatatattataggctaaatatattataggtataaagtaggtatattctaagtatatacttaatattatactaatagaaatagtgcccttaaaagatttatatttataagaaaatagaaagatacttattaaggggaaaaaaactctcgcgctcccaacacgcccccccaatttgggggtattcgaactcgattttgacaccaatttgttctactcatcaaacttaataacatactcgatttttatttcaaattacccctttgttgtcggttgggaagaccccaaaaccccctgtgagccggcaaagaaaatttttgttttccctcccgctacgggagcccagtcaaacaacctgcgcaaggggggaagccacgccatagaccttccagccgcaccacgccacactggtccctccacaacagttttatagtgaaaaatatagcactatagagttatatatagttgattagaacttctagtcattatatataattcctataactatatttgaatctatagaatgaacaagaacgataacgactaggtcagaggcaacgcctactagagctataccgaagtataccactagtagtaagaagtcttactgacccccaaagtaagtatcttagtaactcaggttaaatggattgaattgagcgcgagtaaggaaaggctagatacatgagtataattgtccttatttatgtttcttccagtcttccttcggccccccttttggttcctctttcggtactccttatggtataccgttcccttcgttcgtatgccatttcgtataccattcgtataccatcctgtataccattcctcgtgatcctcaatgttcattcttgtcacgtgatctggagttcgccctattgctgccttgcggggtaattgtttcatcctgcattgctgtgttggacagcgttatctcctgttggctcataacacgatgcaggatgaaacgattaccccgcgagacagaagttacacatacgggtataccattagaagtcacgtgacatggtataagtataccatccagatataccaggaaaggtatacaaaatggtatattcgggagaaggcataaaaggaggaaggattccgaccatgtatctagtctttccttactcgcgctcaatttcattgtctttctctgttactaagatacttactctgggggtcagtaagacttcttactactagtggtatacttcggtatagctctagtaggcgttgcctctgacctagtcgttgctatttgttcgtctaagatacctttatcgtgtgttcttgggagaccccttttatacttgtgaaaggacgttcgaggaagagcccttcgccaggtaggccgttgtctcgagagaaggagacccgggtcagttagaccgtcgcgtgctcgtgaacgacataagagtcggaagactccttgatccttccctaaccaccactgttaagtatcgacgactacggttggacccagcgcgtaacaattagtcacttcttgttgaagctgactaatggcttgattcctagggttttggttggctaattgggggttttggagcttttggaggataaaatcaagatttttgacttcctcttggatttcagctctaatttccctattaggttcatctaggaggacctcatttagaaggtctctcaggaagattgtataaaagaaaaccagaggaggtaggtagttatgggagggcactctgtatatagagaaaataaggttgctgcatgccgagtctgggacccggctcggctcatcgagcccactcttagtcccacactgaccctcctcttcctcttttaggtctacctcttttaggctcaccacttatagtgggtctaagtgccttatagacttggatctatcattgacactcaacaatacagtaatctttttttaaaaaaaactaaaaatcattattttatttagtttaaataatttttaaataataaagaaaatattcagaatctttgattatataatgattatataatcgaagagtagctcgactaacctaggggtcagctgagctgagccgaaccagctcaatgtcagggactcagggaagtcgctgcctgggctgtcaggcagcagagcttgaccagttgacacttgacagatgggttgcgacagcaagcgacaacgcggcttgccctggcagtacagtgaaactagttaatctttttttttgacttaacaacgcctctcttgtttttttaaatcaataaacccgttaatattatttatttaccattgcagttcccttagatgactgtcccagatgtcacgttctctggatgtagtaatttttctcattttagcacccgcccgggctgtatgtacagtacatcctgaaactctaacctgtggttagattaaagctatttgacttaccgcctgcgcagcgcagccttccttctatgagctaggtatattatgggcatttctggtcctgttagtagacccatgtaatgggcgaaaaataaaaaaacctccaggtgattctgattcgtaatggcaggcctacgcctgaacaggccctcttgtcctttttcctctagatattgttctgggacagcgagacatcgtggatagagaacattcgtgagcaatgcttcgcccgcaattcattcactcgcgaccaggtcgctgacattgagctcgaagagacacacacgtccagatgatgatgttcaaatacctcgagctggatgcgtctagatggactgtccaggtcgatcttgggccttattctttcgtgtaactgttgactctgccacggagtatctcttcaagcaaagtgtatagttgcagcttttgggtcttcctggccatgatgtctctaattctgagttagactagaagtctcttgcaacgcatttcgacaatggaacagctgcactcagtgtctgtggtcgctggctgtataataaccctcgatcattccgcgaggattgcaaggaaatccatcgttttgcagagcactttgtccaaaaggcgctggacaaagagaagagcggaactggagtattaggtaaaaaaaaatagagatacgttttcctgtaagagctggtcaaaggcatgaaagacccactggtgctctgaagccagctcttgaatggatatcccacttgctgggagagacaccactgcggctgcaggcctgctgggatggacgtgctggaaccttgctcggcatctagccatctttcgaaagctgtgagcaacaactctggacgtgttcagcacttatgataacacctagaagatcaccattttttcgcctcaagtcctgttctacctgcagtacaccatgaacgaaacgctgtagcttttcctatctgttccgatcaacacttgacaagccaccaaggaatatgagtctgctgtatggtggtggtcccgacgggcagtctccatattcgtccgaaagggagtggaagtcagttatagcgtttatacaacgcatcaacgcaaggatctgtgggggagcaatactccgtacaaacaagttcaacccgaccaacggtacagccggaaaagtcttccggatctgtctgaggcagcagcagtttgccctgacggatcggaagccaggtaggtactgtaggtacagtacatgctcacgaggctggtgactagtcgatccagaagctgttcgaccggatcgaaaactgcgatgctccgtcatcagtatagtatagcgttaccatggatcgatggcatccatggtggacgggtcgggtcaggtacagtacttgactaccggatctagctacctagctagactgctagactggtttgtgatgtcatcacctcttctattattgaaggaagaagagcattaaatcctttttttttgggtgtacacactatcacattctttagtaaggacatgcatggcaagatttgatggcaaaatctaggctcgtccatattcatggctttgtacagtacatacctgtctgtacttgtgtacctatatctagactatgttactgcgaattggcaattgcagtgcaggactgagacgaatttaattaattaaattgacgatgagtatcgtatctaattcagtccagatcagttcgctatcgcacatgacgaggcaaacaggcatggagatgataatttgttctgctctctagcataccgacgtatctgcaaattgcaataaaaaaaccagcaactaactaagataataagcagtcccgcccgattcaatagaccagatatcatgatcaaaagaggaaaaacaaaatcaaatcgtcataacgccgttgccttgactccgtgtccctaaccatgtaaaacgtcccagtgcagttcagtgcagtgtagtcagttctgatcaagttcataataccgccatatccgaatattccagagccgagtcgaatagtagaatgcctgaaaagaaagtcgagaccagacttgtgtatgtgaatatcatgccgaaactggtgctgcttcagacttggtcattatcgacaagttgacgataaagcatgaagcagtttgagtgttgaaatgccaacccagtcaaggttgtcaagatcagcgagatgccgctcgtccgtgccgttcggatcggttaagcctccccctccatgacctcgaatatcccgcccatcacgaaccgtggcggctgcgggctcactcgcatcgactggctttgcgattgtatccacgagctccgttcactcgagatgtcccccaacacatgggcgttcaggtccatggcgatcgggatcggatcgaccggccgcggctccatcatgctcaggcctatccgctcgatggcatcctcgtcgcatcgcgaccgttcttcactcaaggccaaatctaccgcggagggacggtgacgcagaaagacgggcgagcggcgggacgagaaggaagcgacggtgaacggactgcgactgcgactccggctgtcggagtcggcatgattcgagccggagaagcggtgcttccgatagaagctgtgaaaggtcgagccgggagacgacgtgggactggcggtggccgagcttgggcttgctgaagcagagtcgctctctgtgcgatggtgatggaatcctgtgtgcagagacaggccgaaatccgccagaggagacggagcgagagccttggggcttggtgaattctgacggtgcatcatgaagtcgatgatgatgggaatctaatccgaagcagagatggcgatcgaagtataccaggaagacagcaagaaccgggcaatggagggtatggagggttctttggaattattattaaatgacgtagtgcgagctcgctaagcgaaccaaaacaaaaacgaagtccaaggtcctgcccggctgcgaagtgaagagtcaaaacaatgctgtacaagccgaagctctagatgccagctgttcgccccggattgttcttcggctgagagcactcagctcaacggctctggcgtttccgcgtcaagatgcttccggcgtctgcggcagttcgagaaaggatcggttggaggctaggcgagttgaggaggagagaagggtgggagaggcgagtgaaggagagagagaagtgttgagagacgcgttggcggcagattgaactgagaggtcaaggcggtgggccgcgatattaattgtgacgacagccgtccgagttatcaaggagtggagagacagacacgacaggcctcccctctcgttctgcagagaaaggggttctctaggagttttcttttttttatgccagattctttccctgacaggggcaaaggggacaagaatgctttgtctcggacaggcttagatgtaaggacgagaggccggggccagggccaggatcccgggaccaagggccagaaatacttggaccattgcaacgctagctaataatgactacctaggtacggtttatttacggagtacggagtcatactggaagcagagaacgcccaggcaccgccttgggcccactgccgcatccgggcctccggatacgacagacgcagcaattccagtgacaacaatagcagccgatcgcccgtccgtcaggcaccgcaacggctaacggctggacggagtaatagtcgcaaggcgcagctgcttcttctgccggattgagaaggccaacctcaaggctcaagtgacagttcctcttctccagcgtggcaaactccaggtgagacactcgcgcgggccgcggcccttagacgcgtcacacgatgatcgatcccgtcgggtcggcccccgggagaagacagatatcgcgcagacgcataaataatattactcggacgggggattccctggaactgtccagaatgcaccatgcatggttccctgcgtcgcagtctgtagggcggccggtagtctcctcgtggctcatgcacggcacggcaggaataatgcattatgccctcggtcggatcatcacgaaaacgttattgctgttaaatagtctcgatgccatgacgcctgccaagccaatggagcgaaaactaaccgtcgtcgcttcccagggagaagtaaataaatacctcacgctggtcgaacggcaagtgtgtcattgcagtcgcacgagttcaagaaaataatacttagttactaattcataacaatgatcgaagagcaagacactacagaatatagtccgaagtgcaccactcctactgtagcacctgatataatactacgattaatgttgcatgcaggactgctaatagtctgtactccgtactattgcattccacattccgatggctgcagctgcagtgaaaccgcctgcgcagctagcccggtgcggctaggctgcagacagcgtccggatgcggtagcagtcaacaacagcagtaataataaaataataataataatgctgcctagaaatgaaataataatacaataataatagcaataataataacaatgctggttccagaatgctggggtcgaagctttaatgagccccatgcagacccgtggaactagtcgatgaccatcctcgaaaagggaagtaagcgtgctccatacccaagtagatagatagatattctacatacacggttctatccagtccaacagccaacaggtacctcttcatggtatgcaacagacgagaaaaggaagatcgctagaacaggaagacaatggcctacaagcctgacaaaataaatagcaaaacgccgcccatgccaatgccatcatatatagaaacgtctacagaaaaagaagcacaaaaggccaaaaacgcgtaacgcgacgttgatcgagcttccaatgcaaggatcaaccgtggggaatcatatagcaaaaagaaaaagaagtccacacgtagccaaccccatccccgtatagatcgtagatatctcattagcgcacctcgtcatatatatgtaccatccatcgtctcgtcgtttcgccattgccaatcgagaccagttaaggctgatggcctagttctgcgggcgtcgttgcgtgaagcttcgtcgaatactctcaccccaagcggactccccaagggactgcatcatgtcttgcacgctgaccgcgctggtatcgtgaccatgccccgaaggcgaaggggaaccaacaggagacatctgtccggcagcgccatgatactccgtgtccgtctccctcagccggcgcggcgacagggtcgagctgaccctctcccactcggtgggcgagcttcccgcagaaccccgtcccgaaccgctcgtgtcgatgtgaagggtcggtttccctttggcgggggatgagcttgagcgtggaaagtcgagagagcttggcgacgccaagggtgatgacgccccgctggttacatctttgtccttttcctccgcattcccgtcctggtgggcatccacaaggatttcgggcactgagaactcgggaaccgtgttcatgcgggccgatttccgggactcgagtctgcgccggaattgacgagaccagtagagcgtgtcgaagaatccaatgacggtgtttcgccgaaccgcctcttcgacgcgctggagcctggtgcgccgtcgcagaaattcctccaatctggatctccggtcagctcagaaacgaagacaacaaactccaaaggacaacaaacctcaggcttttgctgtcgttgatcaccttgtaatgcgccaggatcatcaggcaggccgaaaatgatatcccgcgctccggatcggccgacaccaagacttcttcgtagaaattgttcaacatccgtcgtctagctcgaatcttctcgactgggattcgatcaacaatttgggccaattttcgaatgtcgatttcttggttggcggggttctccgggtacgacaagatcgaatcccgcggacggactctgcactgctctaagatgctccccactgtgaattcaccgtcgtagatacgcatctcgaatacgccagagagttcctgagaaaagaaaaaaaatatatattagtgtccttccgatgcaagatgcctgccatccttgtacataccccaagaagtctcggaaactgttctttggatatgaatccggtgccatcggggtcaaacgtcgcccaagcttgtttgaagcggcgaatgtcgtccctgctaatcgcgtagagcccgctacttcgctggtacacataagagaaactttcgaaaatgagtgatacgaaaagagagacgaaaatgtacatgctgatgatgttccaggcgataaacagtgaccgggcccaccctgcactgccgcagtccgacgtgtaaaagttgtccgtgattgtgcagtacggcgggcgcatcgtggcataatcctccatgagctgattccagccctcgccgcaactggtgcggaaaaggaagatcaatgctttgggaacatcccggaaattgatgttgttggtctcttgctctccgaatttcgtgagcccgaacgtttgggtcatggcgatggcgaagaccaggaacagaacgaaccaagtggccagaagattcccaatggccgtcagactggctgcggcggtcttgaaaagttgatccagctggttgttgcgaggaatgatgagcaacgtcattgccacgaggaaaagcttgttcagctcctggaaaagctgagtgggaaagatgaaggccagaatgatagtaatgaaagtaccgggaactgccaccagcgaatagaggtcccaagagcttcgcctgaaccggcgccaccccagtccaaatattcggataacgacattcgcaatgtagaaaaaggtaaagatgaaaaagaggatacctggtcatgttagtcttgtgtccgttataccataaagaagaacagctcagagtgcttacttctcaatacgtcccacagcggcgctgacggatagaactccagcatgagaagcaacaaatgcagcaaaagaatggtggtcacacatctggcccatctcccatgtttcttcactgcaatgcgatagcaccacagccgccatttcttcgtcttgctgtcgacggatctcttggagggagaaatctgcctgagaagcttccgcaattcgagccaagagcgttgttcggcggtcaagaacgcaaccccggtctgttcggtgtagtttctcatgaagaccgatacgaacaaggtcaaaacaaagacggatcccaacagattgaagacaacaaagaagagcccgttggccggagaggcaaaatcctgaggctgttggtccgcccctacgatactcatgacgctccattgtacatcgatccagccttcctgagaaacgatctggaaaaggatgaagagggagtgggcaaaattgtcaaaatcgaagtatgggttggaaacagcccgtggagcgagcacgttccaattgtaaggcgagctctgatactctccaatgcagtagctgagattactttgtggcggattaccgtcgttgcactgcatcaattttccattgaacaggttgagtccatatatggcgaagggaatgaggaagctcatggagacaaatgcggcctcggtaggcgtcagctcgagactctgggcagtctgtcgaattcttcaagtcaacttaccgaaataactttccacccacccacgatgatgacagagtagaacgtgtctctggcgctgtcactgacattgagcaacctcaacgccctcagggctttgaaggcgcccacaaatcgcgagacagtgtcattgtggtacagggatgtgatcacattaatccagagggtgatgagcacgatgccatcaataaagccccaagctccccgaaagtacgcattcggagtccaaaagaatccatccgcgatcactttgatggtagcctcgatcgtgaacaatatggcgaaacctatgtcagtccagacgaaccagttcaaaccagtggattcactattctggaaatactgcttttggtagaggggcgttgtgatacaggcgaggagaaccatcgcaacaatggccgcgtagatgaatgcagagaaagagaaccaaagaggcttgtaagggtcgacgccttcgaaacgctgatttccccggccaggtccgacgatccgctggcatgctttgcggatgggattgtccggcgcaaagatgaacagcgacttgttgtagtacggatgcctcctgagatattcccgctgagcgcgttttcgctgctctgatgccataacgacttccttagccagagttctgggatccaggtcatcataggctcgagaaaactgcagcttggagtagaacgggttaggttctcggtgcgtaattgacgtcgtgatcttggaccaccactgcgacagaagacccggcttgacgctgcctgcccgcgctgccgttcgagccggactgtccgctccgtggtcctcgatcggtgctcgctcgtcgagaaactctcgtactacagcatccttcatcagcatctccatagaggccggtccgtaatcgagcggatctcggtagcggtccgaatcgcgacccaatttgaatattgcggtcagagcaagatttccagtcgaagaacctcccacatccttctgttgtaagaaggcttttacttggtgcagtcgcttttggtcttcagacacatcaaagctctcttgaatgacagcaatgaacatattaagaatgataaaattggccagaataaaccacatgataaagaaagacgcagagatccaggccgtatgagccgacaccgtgaaattggtcgaattataaaggatcgtcgtccaattctcgctagacaggacctggtacatgccgaggaacgcgttgtagatattgtaaaaggtcatgtggatcgtatttccatcgggatcctgttggggaatctgtccgcgaaagagctgcaccgcaaagatagcggcaagaaatgtgatgagaaacacaaagaggatcagattgagtagaccaacgacgttgcggaacacgaccatgatcaggtctcgggtgagcgagaacgccaagacgacgcgatagattcggagtatttgaaacagcgagagaactgcatatggctggccagagttacgaatcggtgggatcaggataatgcacgtaatcacggcaagaccaagatcaaccaaattgcgtttgctcttgtggaaacgtctccagtcggacgcaaagcggataataatctcgaccaagaggagcaaagtgaccaccgtctcggtgacgttgatggtggtctcccgaccgggtcccatagatgcactccggagacattgaacgataagatcgaatgcaatgagtgtgttccagaaccattccgttttgtcgtatatacgcttgagggtgctgactttttgaggcgccgtctcttgctggttgacatcgtcgattttctccatggtgaaagcgctgcgcttgctttcctctcgaataacttgaaacgatgacgtgatgaccgcgactaacaagttgaccatccacaggctcataatgacaagaccaacaacaaagaacagagcggctgcaagatagtcgctgtcagtggtgtaatataggagatccgtgaacgtgttagaactcataatcacgaacaccagctcgagcgactgcaaaatattatcgaaactaacagttccattgtaaggattagtcccttcaacacacatagaaccctgaggacagaggtatcctttaggctgaaaacccgagggttcaccattcgcataaacccatggctttgggctcccagaatctggatcgagataacccccgcaaaactgaagggcgttatatggatcgttcatggtgaagttattttggccctcggggtcgatccacacgcaggttcgtcggaaactggacttgaagctttggatccccacgatagcgaaaagaagccagaaaaagctaatgagaaatgcaacatgaacgagcagcggcgcagctttcttgagactccgaagaatcacctactcttcagattagaaggtgttgcatgacggattccacttcgccgcatgacttaccgaagtaccgttagtgatgcccagaagccgcaatattcgcaggcagctcaacatttcgaatatgtatatatgatgagaggactcgtatcccaccatggaaagaaagaaggcaatccagtacgagacaacagcaacaaaatccagcctattaaacgagtgcctaaggaatgcgcgatgggcaagtcgaacgcgttgtctgtgccgaggatcgtccgacacatctaccgggggctccatgccagtgaaggtccgcagaagagaggcctgtggttcagcagcggcggtagatttcttcgtcgatggctggcgttgcaacgtaaacaggctcctccctttctcagccaatgcttttttaagcccaagggagcgatccagagtactgtattcgataggattcatgataaaaccggacactatgatcctcgcgatcagctccagggtgtagatgacgaagatgacaaaaaacgaataatccagtgacgacgatccccagcgtggtgatcgtggatggtcgtagaccgactgcgccgactcgatagttaataagatggtctggatgatgatcaccactaagatgaacggctcggtggtcggatgaacgagaatatcacataaccacgtccgtagtgggttgtctggagcaaagatgccaagagacttgcccctcaggggattggagtgaaccttccatgccttgcttgagatatgcttctcgtgcttactctcttgtgacggatcatgatagtcgaccatggctggaaggtctggcggcccctcaagtcgcgcactcttctgagagctggttcgtcgcatcgactgctccaccacttcaggctcattgctcaggttcactactcgctgagacatcatcctcatcactgagcctgccattgacaaggctgagccagacgccgatggcgataaggatcgagaacgagcgcgcccgccatcagtgctacctcttccaccggttccaacctccagatcatcgcccaaccgtgagccgacttggctgcccagacgaacagtctgcatactgctcctttcctgatcctcttcattggtacctggagctccgctgatgggttggagatatttcttatcggtcaagggcgcggtgtcttcgtttaggccgacgggagagaaatagtcgtccacggagggtacactaccccgatctccccgtcctggataagcacccatcatatagccttcatcgtcgtgaatagaggtcgaggaccccgccagaggacgagtgctctgcttgggcccgtcgaaactgagtccgatcgagcccacagcctgggcaaagcctcccaaatcgtccaccacagtctcattgtcgccattggaaatgtaaggggaccgctctggtcttgacctcgctgtggacggctgcgtgagatgaaatccgaccctttcggttgggcttggggaatcttccgcaatgcgctcgtacgtcctcactgatccgccggtgatcaacgaccttcttggaacatgggcgcgtccgccgccagttgtgctgctgctgctgctcctcctcctcgtcctcccgcgctctggctcaccagtcacggcagtccctgattgcctggatagatcctgcaaaggtattgactggtggcccgagttatcctggccaggaagctggccgtgaccattcgacgccattgtagctggcgactgctatccgatcgcatacatcgcaaatcaggaattgtcgtcaaggaactccggccgcatcgacggtgttgcttgtcgtagcgctgggcgaagaaaggcgacgcgttgggagggttttcgagggaattctcgagctcagtggggttgcaccaggggaatggactcgggaatggcagctgcgcaccaggcggaatcccgttcgactcgagatggaagctgcttgcgacgcaagtcggacgcgatgagaaaggcaatcggcacctttcgtctctgcaacgcaatggttcccccgtgtgcagccactgccggggtcgtggccagggcctgaagcttagtaccaggtcgttggactcttggactgtcgcaggctggcactaaaatgcagacgatcggctgtcttctcctcgcaagtctcctgttggcttgtcgctgcgggttgcgggccgtgttgcttatgtgacacgcggagaccagcgggcaggtcacagagaacctctgtccatgctttgtctattctgtgctatatttattaggttttttttttgcttgaaattattctgtactccgctcgtgttctagcctacgcggttatctaattttttctacgtgttcagatgaagctgcagctatcaagcacttttaggggctccagttttagtggccgcgcaattgtaacttgtctcaggtccagccaataggcggtcggattccgcaaccttagcgcctttacctaagctacgcatctgaaaagcttccaaaaatatccgcgttccagcctcacttgcagagagtcaatcagagcgtgggcgcgctattagtccattactcagaagtctatgtagctgtgtatttctccatttccgggtaaagagtacatagggtacgtcgtaacatgcgtgctgtaagacaaaactgcttttagtcggtttccatgcgctcgtcactgtgcgattccttcttttctgttacatgccttcggacgccttccaggaatgcttcaaccgcgtcgccaccacccagaggcaccccacctccgcgcacgaaccctccattctctaccgggactttgagagcttcactgatactgggcaggcccccatctcggagagcgacggtgaggcttccgagactttgggtaaactgaggagagcgcaggactcgccggaggatatctttcttctggttcaagtcaagagagagcaataccgcttgcgcggtctcggcgttggcatccgtggcagatacatcctcggcaccttgcgccaggaggattaacgatggtggcaggaaattcaaaagattgtcaaccgcttgctcgtccgcggattcgaccatcggaagggtcgacgatggagaaagcaggtcggttagggtagtgaaaaggttttcgtgagcctggggctgaacgttctggttcccttggagggacctgagaagaccctgtacgacagacgacggatcagatgacggaacagtagccctggcgttaccttggtcagcaaatgaaccttacacaagcctctggatctgggagtatgagagtaaattggggtgaaggtcttggtgttgtgcttcaaaaaaattctttttcctctctttttctttttatcagaagaaacacatgccataaacaccttcgaaaccaaagggcacacagatatgcaggtaatgaaggtcgtgctctagagagttgtacctacgctcggccaccgtccgcaccaccctcccgggactcctcgccctcttctcggatatcacctcctgtcgcatccaggccagctccgccgctgctcccgcggtggtcggagacattatgagatccctccacgtcctccatggtttcatcgtcatcgccgcctcgaccgcctggaccccgcggcaggttcgcgatttctcgttggacatcgatctcttctccctgaagcagagtgttgacaatctctcccagcttcaggtccctggggctgaaccagctaagattgcctctctcgtgctgggtcttggattgcagccagaacaggtaccgctgggagctggacgagaacttcaagacgtagatccgcccattggtgggcgccttggtgcctgcttgtggggacttgtatggtgtgaaggagccatctgaggggaccatcaccagatccagctcgggctccgtaagtggtgcggagcgagggcgccagcagaagtggatgagttcatcttcagagtacaagtagatgtaaccgggagtaggctttggcttgactctgtgcggagacaccgaagtctgggagctgctgtcagttccggtcgacagctgggatatcagagctcattcagactcacatctagatcgcagataccagctttgaaggtgataatgggtactatcgacatggcgtaggtctgcgtgaatggcacgagaggtacaacggagactcacagggtctgtggtccaagacgcgagatatcgaggctggtcagcaccgtagtaacgtcagcagtgtggtgttttggcctggagagcttcgccgtccgccgagactgcgggcgtggtcgtcgtcggccgccgtagcagtgggcgggctggcagccgcgagtcccgtgacaaaacggcactagcgcatttcggctaaaggatagggctcgcggtgcccacaaacctcgcgatttcccgccctgggccgcaccaagtccgtcacacatcaattcaacaaccaccaccgtcgacaaccaccagccccctcctactttcttttccagcgttccttcgtcaccagcagccaatatgtcggactctactgttggccagacgaagaagtttggaaagggtgagaggacagttccgcacccaagccagaaggctcagaaatggtaccctgtggatgatgaaccgcaacccaagaaagtcagtactcccgatgagaagatgtggccaatttgtgtccaggaattgcaattgtgcacgctggctcaggtgcttgggattggtgcgaggaagagtcgattttgattgatcgcgataatggtcgattgatcgctggccatgatacggaatggggactcgaatcgcatcatctgtttcaggcacttctactggcagcaaaagcgcacacaaagattgctagtattgataactaacatcctgtgtcctccaggtccgcaagtccattcgcccgactaagctccgagaaagcctccagcccggtgcgatcctgatcctcctcgctggtcgtttccgcggcaagcgggtcgtcctgctcaagcacctgtcccagggtgttctcctggtcaccggccccttcaagatcaatggtgtgcctctccggagggtgaacgctcgctacgtgatcgccaccagcgcccgggttgatctcacgggaatcgacacggccactcttgagaaggtctcggcaccggactacttcaccaaggagaagagcaaggagaagaagacggaagaggccttcttcaagcagggcgagaagccagaggtatgtttcggactggatcgtgtgacgaaagcagctactgatgcgggttgtgcggaacagaagaagaaggttaccagcgctcgcgccgccgaccagaaggccattgaccaggctcttttggccaacatcaagaaggagcagttcctcgccagctacctggctaccagcttcagcctccggaatggcgacaagcctcacgagatgaagtggtagagggtaggcgtgcgcagcgggggctgtgtggggtttggtgaggttaatggatggatgtttcaagaaaattcaagaaaccggaaaagggcgacaggcgttgcaaatgggttttctcataccgtgggatgaaatatgcgcgagtgagggaagcatttgcactgcagcgcgcgcgagggggaagagaactttcatgaatgagacatgtaaactcgatacgaaagtcccctttcttcttcctttttttattacctagaattgtggtcgcacacaaaaaccgatatttgttgtttatttgttcgccacaaagcccggtcgatttgggttgggaccgaaataaaaaagaatcttaaaaaacggaacacaccctttcccacgaaggtgctacagtatatcatttggtaaatgcgatagatctgtatatccaactatcttcgagggacatatattcatctattattgttaacccgccttcttctggtcttgttgccattgccctttttctctctgagcagtctccggtattcctcaatcgccttgcggatcatcttctcgtcgatgtcttcttcggctagttgatcctcttcctcctgctgctcatgatcttcgacagccggggcggtagtgccgcacagccaatccagcactccccacacgccgaagtaacaattcccgcctcctccgccgccattgttgcggatcacgtgcatttccgccctccgcgctacaccgcccaggaagaaccccgtcggcagcgtcttgtacccggaatacgcaaatgtctcctctagcgagacgagcgccacgaagagcatgtacgtcgtcatgtggaagcggaatgctgcggctgacgcgtagagcgggacgaccttcagcagcaagtaggggattgggtggtcgtagtgcgcagtcagcgggtagggcacgcgcagggaatggtaccatgacaggtggtatcgcgacacgggggagcgtggggagtgcagtgcgaagcggtggatgatgtaggtcaggaactgaagaaaatgtcagtcttacttctcttttttttaactcctgctacgtcgcattgtgcgaaaggacatatattacgggagtacttacctcccgtacaacaaacgccctgagaatatccaaaacactctcccacgggtacggcagacgcaacgacaccctgatggcgcttcgatatcgcagcaccttcgtcaacacatgctcgacgacgccctgcgccagaatcccgcagacaagaagattgcagagcgaccacgccaccacctttgcttccttccatccgattcccaacagccccctggctggcttagtactgcccgtcggcaggccgagctcgccgcgcgccttgatggcaacagacacggaggggaacaggatgtcgaagaggaagaagagcagcgacggcagtaggtagaagatgatgcggacggccagggtgccgacgagctcgacgcgtagcggtgagtgggacagcacgagcgtggcccatgtcatgtagaagaagatgaagttcaggctcgtcgtgaaggggaagaaccacatttttgccgctgtggtgatggcttgcgacgggaattgcggttcatgacagacaatatgacagtgactattcgattggtttttttggtcgagcgcgacgacagaagcgccgtgcgcgtgcggttttataaataaacagtgactaattattgctctggaggaagaattgctgttagatgatacaaaacatatcgaaaatatataggtagagagcaaggcttaggtaggtagttgtagatatgactgtgttatatatatttctatgaactcgactccaatcgaactttgattgttgacgcggggacgcgcgacgtcattcaatgcagaaactgccaagaaatataatttttaccccagcgaaaaaaaaagacttaaggagtactctgtacatacatcgcgttacgaactcaacgtaataatgatacaagaaccgattgactgcgctaacaggacgcaatgtgctaatttcagaatctacgcagacagaaggttgttctatcctcaatggcataataaaatagcccgggttcaatgctcgaatggcattcagcttcttaataacaataagagtaaccaaataggttacctcgtgacgcttaggaataatctacaagaacgagggtaatcgggtatcttcattcacagctgagtctggtccaaagtcaacttggacgagatctgaggctccttcttcactggcttatcccgaggaagtcccttattcttcccccagttccacgccttctttgccagatctggaataacgaacacgaagatcagactgctggcccagctcgtcaaagtgtcgagaacaatgttgttccgaggactgggaccgagagcggtacccttcatcaagtgccccacgagcatggtcgtgataaggtagtcacccctctcgagcgccttgatggaaatcctagcgacttcttccggggtctgcggcttatcggcctcttccaacaattgcgtgagcgcgggcttgagcttctgctcattttcgtacccgggactgagaatgcccatcgggaaaacagtatggatcttgacgtcggcggcaggagcagcattcttcttgttgcgacgggtgccgttgtacatttcgacctcctggcacaaagtgtctgccaacgaccgcattgcggctttgcctggcgagtaagggccgtagccagtcactgggaaaaaggcaagagtggaggaagtaaaaatcagatgtcgtcgcggcggcggcgacgtctgctgactggcctcctctggggagataggggccagccacctcctcagcgtagcatgagccgtatatgcagcggtccaatagatggtgtccatctgatctctcagggtctggatcggtgtgtcgataaagaaccccggagtgcagtacccagcacagcaccaaacaacgtccggagctgccccattgttccacgtcgtcacctcatctaacactcgctcagcctcggcaggattagtgaggtcggcgctgatgtagtgaaatcgctgtttgctcgggtcggaagcagcggactgcgatcgtcagcaagtttccatcttcatccgacaaagtaatcggattctaccttcaagctttccactgcttcttcgagtttcctaaccgttcgcgaaacgacaacgacatttgcccctttctgtgctagctggatagctacggctttccccattccatcagagccgccggtgataacgacggtctagcagacagtcagtcgcattcatgtaattcctctctcatggcacgtaccctgccgtcaaccacgaactcatttcgtgaaccgaagccgaacatcttgagtacggcgtaagtcaacacgccacatagaatggccgaggctcccaggacagcagccggatagctcatgggagcaattgggttcgaatcaaacccacaaagtgataacaataggttgataggaagacgctctcaagaggtaaaccgtaacctaatcacctcgagatattggctgcaatacacttccgccggcagatcgctggaaatattacgtaccgtaccgtaattgccagtactccaaattgcccaatagactttcctatcttgaaggcggtgagtgcggccctccaaaattttgtcgccaaaaaaataaaattggggaaactccagagaagcgtggtggacaaacatcgagctgtgctcaactatcttccatctccatgggcaagaagagaaaggccagcagtcggccctccggggagactgctaagaacgacgatgatgcccttcagtccaaatacgacataaacgaaacgtttgacgactccgaagatgaattcatagccggccgcgaccagatcctcttagacgagggtccggaggccaaaagacggcgaaaattggaagaggatggtatgtattcaaaaatcttttttgagggatttaatcgtgctaactgcgttgcagatgaatttctccagccgtccgacgaagaagtcctcggctacgaatctgccagttcggacgacctggacgaagaagaagaagaagacttcgacgaggatgaaggagacgatgacgcagaagacagcgacgattacgagtctcggaaagagtcgagaaagtcgcgaaaacagcgcgatgcgtcgagccctgcctccgagggtgaagagttcgaggatggtattggcgcgtggggttcgtccaaaaaggatttctacaatgccgataccatcgaaacggaagccgatgctctcgaggaggaggaggaagcgaagaaaatccaacagaagcatctgaaggctatgaaagaggaggactttggcttcgacgagacagagtggttacaatccggaaaagcgcctgatgaaagcaagaaagacgaagatggcgtggtcaccgaagtgctaccacagctagagattacggatgatatgggaccggaggagcggctcaagatactgaagtcaaggtatccggagttcgagcccttggcgaaagatctcgtcgaccttgagcctacttataaggagctgcagcaagccgcacaagtagcggagaaggcgatcacggatttctcgaaaccagcgcctgttccggtgatcaaattccgtgccctgtcggcttatctcggggctataagcatgtacttcgcacttctcacatctccttcgcagaatggggaggagaaggcggtcgctctgccccctgcggaactgagagagcatccggtaatgcaatctctagtgaactgcaaaaagctctgggacacggtcaaggatctccgcgtacctgacgcttccgaagctgcagaggtcaatggcacgggctcggagagtgaagtcgcagagccaacaccgccccctgctcctgtcgagaaatcggagaagaagaccaaggaagtcaagccacctaaggaaaagaagacgaaagcacaacctgctgctgaaaaggcggcagctgaagctgaagctcgccgtgcgaagaaactccgtcagacggaagctgaacttgctgacctgtcgaacctggtatccgctcctggcaagaagtccaaggttgcgaaggtctcgaagaagaaagatcaggataaggatgactccgacttcggtgatgaggaagccctcacagcatgggaggcggaagaaaaggcgaagagaaaacggtccctccggttctacacatcccagatcgcacagaaagccaacaagcgcgaggcagcgggtcgcgatgcgggcggtgatcaagatctgccgtatcgagagcgtatcaaggatcgccaggcgcgactgaatgccgaggccgagaagcgtggcaggcaacaacccaatccgtctgagcagctgggcggagactctgacgaggaggactaccgtgtcgccggcgaggtccgcggagacgctgttggcactggccgggactctggctctggctcggacacagatgaagacgaatactacgacctggtcgccgcgcgcaagaagaagagggaagaggagaagaaggcgcgggccgaagagtatgcgaaggcagcacaagaaggcggcaaggttgaggtgcaggaggaaatcggcccagacggcaagcggaagatcacgtaccagatcgagaagaacaagggtctggcgccgaagcgcaagaaggagcagcgcaacccgcgtgtcaagaagcggaagaagttcgagcagaagcagaagcggctgggtagcatccggcagatttacaagggtggcgaaggtccaggagggtatggcggtgagcttacgggcatcaagaagaatctggttaaaagtgtcaagctttgaagagctcaggcgatgcatttatttctcgtactgttacatattccattcgctgcaggcgtttattttttttttaattcgaaggtttgacgctgatgccagagtggcatccactgcatcttgggctgtatctatgcacgtatatacagtgtaaatgcaaagtgactgcaatagaatcgacttctgtattcttccagcctggtttatatgaagttcattgggtatacttatccagagagaagaagaaggataagaaaggcaaaaaaaaagctttcaagctagctatctagcacgccattatattatactactatattatcctattccaagctaagtctgacaagttattgccaatcccatcacaagttaacttatactgattgacgactggttagggttaaggtttattatttactctgatggtcctaagtctagggctggcaagaccttgaccatgcttagtagcgcagtagtggggaaaaaaggcctcagtgacgttcaatctgcattcgcacggctatacggctatttaagcgattagtatatgaataataatatcacggagtactccgtaatctgtctcctctgatcgcatctcggagactcctccgtgcggcagtggagatgccggcggagactccgaggaagatgcgatgatatcatgatctagatgaccgctacggagtacagtattagtattagtattagttctgtcgaataatatagttcgttcgtctgatgaataaaataactaagcaggagaagaaagctccaggtcattcgtgatatgaaaggttcacatctatctatatgtgtaacgaaggaagaaccgtcgaattattcatcaatgacatttattaaattcctgtatgcactgtgtactgtacacacagctagcatatgcaactactttccaccaccaccatgacacagatacaaaccgccaatttactattattgtccttctatttcggcgcattcttattccccgggccgtaccagtcgtcgaagccctaaacagcacaaacagacaaacaccacacgtcagcagcagtttctctcactgataacccactactagatctagtcttaggtatggagatagaactcaccaaatcatggccccacgcaggcgtattcacccgctgctgcttcccctttgctgccatcccctctagcacctccatatcctcctttgccagcgggatcactttgaagttctcctcgattcgactagggttgacggatttgggcagcacgacgcagccgcggttgacctggtaggagatgaggatcgtggcgggcgagacgttgtatttcgctgcgatggcgccgatttcggggtcggagaggaggggagagtcttaagaacaaaaaagtcagaaaagacggttgtcaaaggaggaggagaagaagaaggacgacatactcgtcgagcccagagggcagtacgcctccaggaggatgcccttgtcttcacaccactttttcagtttgtgctggggacagtacgggtggagctcgacctgttgttgaaaaaggctgtcagccgccagctgctagcttctacctgacactgctgcttcaacacacctgattaacagccggcacgaccgtccacgtcttctccaggtgctccaggtacgggatgctaaagttcgacacgccgatggccttcaccttgccggcgcggtacaactcctccatctggcgccaggtgtcctgctggttccaggaacggtcgacagcgcgggtgccgtctgggttggtggggaagagcgcggatgtctcgttggggacgaggcggctgtcttagtcgtcagcatacagtgtatagtacgcaaggatttaagtatctagaaggaagagaaaaattggaatgattgctctaaggagggagatacgaacaccggccagtgcaccaaatacagatccagataatccgtctggagatccttcaacgtctgctccagcccggcagcgacgttgggctggtaagtgttccacctgcttcacgtcagctattgcacctgatgtgattacctccatgagcagagggatatgatatggcgacacggacactttactagtgatgaaaatctcctctctcgggatgccggacgccttgattgcctcgccaacttccttctctgatcataaagagggtcattaatttccagcagttccatgcacgatgtagatttgtctggacaaaccattctggtagataaacgcgcagtccagatgccgatagccgcacttcaacgcatgcaggacggcctggcccacctcgccgggtttggcctgccatgtgcctgtcgaatattaaatatataagcttgtgtccagtagactccaattatcgtcgacagatagataggtcagtactagtgtacacagcaaatacacaactcaccaagaccaatagcagggatggaagcgcccgtgttgagcttgaactctgtgggcagagacatggtagatagctagctaggtaggtaggtagtaacgacgcagcaagaaaaaaaaagagaagaagtgctacaatttctcaacctcgcgatgtctgataggtggtacagtatataagtaataataccggagacaaggtggagaaaaataccaatacaccccacgtgcgactccccgctccccgccccgcgggcctttcgctgttcgggagattattggagcgaggtggctgttcttatatcgtcgtatacgctctcccgacgctgttccttggtggaacatgatggactcatcaaggagtatgtacgttggacgtatatttactcttagaagcacctttcttctctgctaagattcattaaaacgtgtctgaatcgctgcgcgatcccccaggacatattttctagcctctcgcaaaaggtcgacagaatttttgataccgtcagctctgccaggtccccaagaccttgaaacgacactggaccgccattacgaatccatccttcgacatcatcaaactcagaccctatatacggtttatcagtaggctgagaagtggacgcatgttaagctaaaactcacaggtaattgtcgttcggttctgccccgtaaactcaccacccagtcctcccccgaatttgatgatggcccagaatgtgagggcaacgtcaaagatccaaacggtctccgacggcatgctattagatcgtgttaaaattagcagcagctataaatatttcacgacttactcaaaaggaaatctcgtaagaagcgcgctgagctggccagcatggacgaggatcgatctggcaccgactggatcctcggctatccgctctgacagccacaatcttgcatctctcttgctctcttccgtcccggatttgcccgcggcgattttgatgttgtcaagaaagccgggccaagaaaattggatgtgacccagatgagaaagggccgaaacactgacgatcagcgagttcggtatgcatgacgaagagtagcaagaagcagagagctgatctaatagttcctgtgggttactgaatgcaattgatcagccgtcaaacggaaaatcaaacctcgaccacgattcggcttactgcttgaagttcggcggaaatgccagccggtacggaaaagaatccgtcgcgacggaaggttgagaaaagataggatcgaatgcagaagcgtccgtacaaagtctataacccaattagaccgagacgaaaaagcacatgacagcctgcttgccctcacctgtataaggtgtgagctatcaatgagaagccaaatgggttcagaggttgcggcagctttccggctgaaagcagcgaatccaagacggtccggaagttcgaagttttaggctgaaacaactctgattcaaaatcaatggcagctggaggtgcattccaaatttcctcgtcactcggaagcggcacattaatctctccaacggagaaaagtggcgaaatattcagcagacaggaaatttgcatatcgtaaagctgtaaacaatgttaatgtcaaactttcaactgtggagtcacacctacatatattccccatcccagacgacgccgctcctcatcatctgcgtacgctcggcggagctcttccggagtagccgtgtcttttcgtcgctcaagctctttaacaaaggtcaaactaggacgaaggagatgcatcctccgtgcagccgtgacaagaccgcctcgactgatttccgcatgctgatagagcattcgcgagccacagaacaacccaaaaacagactgcaagagccaagcctggacaacagatgtatcaaacatggctcgtcggtcgctctccctcatgtaagcaatggctcttctagctagctcattcagggccaccgcgagtccatccaacccattccttgaatacattgcaccaatggctgccatggcaagaagcaggaccgggttcgcctccgtcattctgaaagtggaccgtcgaaggatcggaagagtctcgtggaaatggcggaaatagagattgatgcaaaccgtcaatgtctgagttgatgggaaagctgtcacatcaactgtcggccagtgagattggtgagacatgccgaccagcgataacatcgcttcgcgggttgactcagtcacatggtcgcaatgggcctcgtgtagtgttggtcgagatttttgagagacaggaggcagatttatccgactatcatccttgcttggtctgtagacgtgtggctgcagggagatcagttacggcctttccatcttctctatttccacttgactccgcttacccatggggtatcagtcggctgggcatcccttattaagtgggatgacggtagaagcgcaggaagaccttgggtcgtatcttgctcatctacgcgggtctcaagcgcagttgagtcataagcagctggaagccagtttgcggggggtgtatttggggcattcgtattcagggtcttcatatggtccgtctcttcgccaatgtgccatccaaaataactttccgaggagtccatgataaaatcatagagtgattccagagggaggttggaaaagtcatcatccgctgcagatcagtcagcatggttcaagagggcgatagatcaggcttaccggtgacggctggcggggagtcagcagcaggaccatcgtttaatctctgatatgttgtattcatggaataagaagtgactcccggagtcggatgaagagtcgcatcctctgttgacatctggccattggatgacattactgaatccgtctggagcgagttaattgacgcattatcagaatggattggcacaggacgacttgacgttgttccccggtttctgtacaggcaggcatggcctgaagcaagacacctgctgcatgtactccctggctgtccgtcacatcggactttcatagcggcacacgacatgctatatccacgcgagcattagtagcgatggtgatttgatcgtcgagacaactaagaaataaaccagacccaccaagagatcttgcggggtatcttcaccgcagaggcagacagtccatgaagggctgcatgccttgtcatcacatccctagaggagatgttggtttgggccatctagtaatttgcggtgtgtgagcctcacctgcggacgaagcgctttctgcacgtcgggcactcgtaacgaacatctccggcgtcttcgatgacaagggtcaggaactcccagcacgaattcaaatttactagctcaacagcttacgacttcgctcgtggcgctggagatgctcgaatttcccgaacactcgtcgacagtcgggccagctgcacaccagcgtccgctcttttctcgcccgtttcttgggcgggccatcgtctccaggaatgggcctctgttccggagaagaattggcttgcatcgttgccattgccgtctgctgtatgtcaatgggttgatggaagtcgcccaggttctttgactgcatgtccgggcatagttggacgatgggatggaccttcctaattgggtaagtagtcagcccgggaaagcacgggtgattggttccttccagccaggcagaacctacattctccccggccatcggaccttctccgaccctcggacttttttcctgcagctgtcaactcgcctgaagcgatcaatgcatacagagtataaaacattgatttaccgtttttgcgcactgtcaccaggtaagggaaatggcgagaattatggctttagggttaaagggatacggttaggaaactcgtctgtgaagtagattatctcaaagtacttgtagaaaacccttggcatagactaagtattttctcttcgaatcagccgaaggaaacaagacctggaaggcttgtcttcatatgttttcaatcaggttgaagagatgaggtattataaatttattgggctcaaaacgggcaatttctaattctatgccagcagtcctggttggtgcaggacccataatacacgccatacatctattgtttaaatctgctatacatctccatataatcccctgtgaccattctcatacctctccgctgctaacctcacccgagtgtacccgctcttcgccacctccatctcgcgtaagctcgtagggatacctcttcgtaaggaccatgaggagaagtgcagtaacaatgcagccaaacatcagcgacgtgctcaccgagaagccggggatgtacgccggcgcagtattggagggccagatgtaggatccactgcgaacacggtcaggatgctataaacccgcagtttctggaggacttactagacagaagataggtttgccaaggcactgtaaaaatgactattagtaagagagcagagggcttcaatgtgtgtactgtacatacttcacaaagccaatagccacagcacgcttttccgccggccgatagattgtgttcgatagataactgagagtcaaaggactgcaacaccagatcccggcagctcctaaattgagagagttagtgaaagcattatgcaagacacttgatgaagcctaccaaatgccagaaacgcatatcggactttggaatttttgacagctgcaacgatgatcaaagaaacagtggacatggtggccatagccatgatgtgtttgggccgctcattctgcatgtcagaagagaagcaacacacgaggacgattaccagcgcgaccatatctgaagcaaattaattcgtcagaaattggctggaaggggacaatgtggcatctctttcttacagataggaattgtcatctgcagcactgtcagcaggacccggtaaaaacaatgtaagaagtaggatcacgcacgtattgcacatccatacccttatagcccagggcggccatcaaggttgggatgaagtaggtgattgtgccagcgcaagtgcacagactctgagcaaccatgaaaagccaagtcctgcgcagtgttaactgacagtgcggataacctgcttacgtctaatgcgacttcttacctccagtccttgattgcatacaagaaactttgcagatgagtaatgtcacccgctcgactcgaattgtggtcctgctccagacgacggatggcgtactctcgctcttctggtgtgagccatttcgttgtagcggggaaatccggcaggatgaatctttgtagaaaggtcagatagttactcgttgtgtaattgaactaacgagaaagaacatacagggcaatgatgccacatcctactgagatgacaccctcaactgatagaaccgtcagcagagtccgatcaacgcgagaatccggacttactcagaaacagccacttccatgcgggaagacttccacgatgttgcatgtcgtccacaatcaagccggctagatattgttaggtattggaactacggagcagcaagatggagtatgggtaatcaccgatgaggccaccaacggcgccagacacaagggacgcgcagtagaagatcgagaatcgacgagccagttccgccttcttgtaccagttgctcatgaaaagcagaactccgggctgttggcgcagttagcatgctggatcctccatcacggcatgatacctacaaagtagccagcttcgatcagaccgaggcagaatcggagaccgatcagaccacctttcgtattgactccggtataaccaatgctgcaacattcgcggtcagacttgttgttgaatctaacatattctttctagaagtaatctcttacaccatagcgccccagacaatctaatcgatcgaagcttttagtatccgtgtgtagtccattcgagagtgcaaaggcagacccaccataagacccgggaggtagaggctgggcctagtccggctaagaatcatgttgctggggacttccaggagaaggtatccgatgaagaagatagagacggcaagcgagtaatcagaggagctgagttgcaaagcgtccgccatgccggcctccttcgcatttccaatgctgtgaaattctcagcctaattcgtcgtactatcgacaagaatacctgcgtacttgtttcggtcaaggtcttcccgttaagattgtctgatcagcacttggagtctttctgctagtaattggtagtacacatacaattgagaatgtactgtcggggtaacatatcagtaagggcgcatgatcccacggtacacagtgagcttgacataccatgataaacaagggcggaataagacgcaggtcgactttccacaaaatcctgtgatctcataataagtctcgctcactcttcctgagcagaacatcaaaaccctaactcacttcctctccaaagccgcattttccacaaacggagttgcatattgccctgaggaccgctcctcatgggcgattgctgcttctttcgacatgataaaggtatttgcggggtagtccttcttttttctggggaaaccataaatgtttgatcaacctcaaatagtatatatatgctgattgctgaagctatggagagctccagtcgtgacgtgtggggaagtggagactccgagactatggagaacgcggagtttggccggtggagaaaacatggagtgatcaattcaaccctgggccctgattaactattactcggtctgttactccatacagcaaggtaagcacggtgaaaatccggtctccatcattattgtttgaaactagtgttcgcctccctcttgaacaatattccttcccaacaaagccatcagctcgctccggacgtcccgggatacgaaactatccagccgcggggacttgggtgaaagatccatttccagaaatttccttgcgattagctcctgttgccgtaaacccagtcagcactagatgttccctccacgtggaggtcaggaagactgaaatttcacgttatacagatactcaccgcttcttccagcgcatctgtttctgtttttgacattttggcgcaggcagttaccaggtcctctcctcgagcggagagtgcagtgagctcatttgctctggcaactatgaccgggtcgatgccattcatggcggcgcagctgggaagcacctcttgtcagtagaaagttgttttcggagacagtaggggcaagtacaaagttccaaagctttcattgctacggcccggtagaaagctgtcaaatcgttagtcttctcgttcaacgccttaacaggcaatggtatcacaaacttgtagagataagttatttggtcaccggcctcgtgagcgttctcgtccactcggatttccatgtgtccaaaacccaaatgcggtctgggtctaagaaatccattttcaaatatctcatggaaatgagtcgcagcaagcacttttggtctttcatcgcccaggttcagaagatattcgaatatgccacaagccaatcccgcaccatctgtcaagaagtcagtgagaagaatccaatgacgaagaccacgctgaccgttcaaatcagttcctttgccaaattcatcgatgatcagcaaactcctgtgagttgcaagtttcaaagctagggaaatctgctgtaaattgatcatgaatgtactctggatctggtccaggtcagtagcggtcctgaacaagccgctttgggacttaccttcgaaactgtctctggtgtagtaattcgtgtaaggattttgtccgtaatcccgatttcggcgctttgagctggcacaaagctgaggtttctctcagtctcacaatattgtatttgaaatcaaggatctcacctcccgatgtgtgccaagtacactgtcagagcaacctttcgattctgagcaagaccctttttcaaacgtctctaaggtccatacctgcttcaaatacatgcttttccccgagtaattgggtccagtcaatagtaacatactcggaccttctggtaagcctgcttcattagaagtatctttttgtagcgcatctgaattgccagcgcctcccacgatgaaggtgtcgttcggaacgtaagatggaactgtaagttcttgcagagggtggcttcgagatcgtgagcaagggtaaagcagcgtcgttaaaggagtcttaccggccacctttgatttttatcatgttttgcatagtcatcttcggtcgtatgaacttataaatactcgctgtttgcaccatcgctagataactagcacttcttagcagacatcctgcagatctcgatcacgcaacttaccaatcgagctcaccgcagacgtctgacgctttcacaagcatgttctcatattcaagtacccgctgagcaagttcgtgcgcgatttcaatctccttctctttaggatgttaatatttgatgcttcgtccagatcatcgtacgtagcctaccacaaatcaacccgtacatgtcacccagtttttcatccatttccttcatccgagaatccttgaagtagactctgttttctgttgtaaaaacttgttcccagggctcatcgcctccgtcatatgccgcgcggcctgtgcggtcgaaaggaatggcgatattaaacccaagttgagggaagtatatcacattcacgtcgatctcaagttcttctggaatagtcttcgcgatgtcgatcgcaacccgctttaacagactatccagtccattgtatctatctttcaaaaggtctagctctcggtctacccctggctttacaatggttcgttgctgctccttggaatcatcaatgtcgacctatatacacgtcagtccagctggaaaccctattcttgagtggaataccgtttcgtggatcatccttccgacactatggagacttgcaccgtcgagagccctgagaaccttctatatattagcctcggagccctccatgacaccgcatttttcttgccttgtttcggaaatctaatgagtccgccccaaccacctctcgaagtgtctcctggatatccatggcatggaaggtaaactgatagtaatctattgtcaattctttgttaattctaacctttccgttgacttacgttcaaaagagtgtcccaaacggtacttttgaaccctccaaattttccgcttccattgcttaagcctttgtggaggttagtcatcagaggacgaaggttcttgatttccctcagacttgaattgagcttttgtaatgcaggagcattggcaggtcgggagaagatatcgattatgtcatgtctcttagttatgacatcgagctcgatactaggacgaagaaatgtctgtctaagtcgagtcttcccctggggagtaagaacgtgctgatagaacaacccatatagagaaaagttctttgaacgagaggatgtcttccccggcccctgattgaaggcgtttgggtgcgactcagattgtaatatttgaagggacgagagggtatctgcattgatagacctttttggcggttaacaattatttaatattatatctcgagacaactcacatggttcccttgagagtaaacgattcaatggaccgcaccctaaaagcgccagaaatgccatcagaagggtattcgctggtcctacgccgttgtaagtaagtgaggatggcgccggcacatcctagagacacggtattctccagatcgatgtgactagccagacgtagaagcttctctttctgggaagtaaatcccgcattttccacggttatttgctcatctgtcagtccatcacttggcaccagaaactgtatgacgtctgggttcaccaaggctgccaatttagttttcgcattctggcaattgaactcttgtgctgggcggatatcgacctgatacgggaggtggaattgtgcgtctaaatggaggagtcagtatgaaatgctacaaacaggggacaaaattctcgtcacgacctgctgttcttctctgctgtgccgatatcgcagtttcatctgcacgagtagaactcaaaattgtagttggcttcacctctaacttcacttgataccaagcgaatgttagtaactggggactcatagggtgatcagggaaacaaacacgtctcaatgatttctttgccacctaattggacatcaccaaggatgtagagcttctcttcttgagcgacgtagtaacagcaacctacggttccgtgctctttgatgtctatggccatgatcacctgctcaaggtcatcatccaaatcctcctcaggaccttgttcaacgtgtctcctatcaaccgatcctgtaattgagtcggttggtaggcgttgtaactcaggaaatgaaaccctaggggagcgatttgacgagtagtcgtcttgaggcagtcgagtctcctcatcgcgtcctccttggaaacgtcggcgaaaagaggatgggttgtaagaggtgctaaacacagaatctctctttcttttggaagaagacatcctgtcagttggatcagaatgaactggatagattaggaagcaagcagcggaacactctgccggcacctgatcattgtcatagttccagtttcgggttgtataacctaacctaatcgggatgttcaagctgcaggaagagaagagaccttagttttctctatatgtacatgagtagcattagttacattagattttttttatatagagaggagctcgtcctgagcggagactcatatagtacaacatattatacactttgcaaacctcacatatgcaatacccgcaacaaaaccccatatacccaaataatcgtaacaaaatgcgccgcatcatgattgtattgtatgcataaataacaaccgcataactccttagccgtcccaattacgcctcagaaacaatctcaagaccactcttgtcggaattaaacttcacacgtgccgtgtccccagaagcaacttcaccacggataattttatctgccagcttgttgccgatttccttagaaatcagacggttgagtggacgagcaccatatttgggatcatagcccttctcacagagccattctttgatctcctcgtcaaccttcaacgtcatgcgtcgattatcgagtctggactgcaattccttgagtcggatttcaacgatatctcggagggcactccgggacagcctcttaaagacaatgaactcgtcgatccggttgaggaactctggaggatatgatgcttgcaccacatccatgaccgccttcttcaactcgggagagacttctccatcttcggatatcttggactgctgaggatcagacccaacgaggatatcagctcctaagttggaagtcaaaacaatgatggtgttcctgaaatcgaccttgtgcccttgagaatcggtaagaaacccttcatcaaggacctgcaacaatagagccgagatatcacggtgggccttctcgaattcatcaaagagcaccacagcatagggctttcgtctcacagcctcggtaagctggccagcgtcgtcatatccgacgtatccagcaggtgctccgatcaaacggctgacggtatgtttctcttggaactcactcatatcgaaccggataaccgcagactcggtggagaaaaggaaaccggccattttcttgcagagctctgtctttccgacgccagttggaccaaggaacatgaaagatgccaacggcttgttttctccactgagacctgccctctgcattcggactgcgttggccacggcggccaaggcttcgtcttgcccacggacggactgtctcagggtatcctccatattgatcagtttttccacctctcctgccatcagtttgctgacaggaatgccagtggtgcgagagacgacattcgcgatatcatcagcagtgacggaatcgtgaatgagagtctggccctccttgacttcagcgccctcctttggcagcttggcctcgagactgggaataatggagtatcgcaactctccagctctcgcgaagtcaccctcacgctgcgccttttccagttcaaaccgtgaccgttccagctcttctttggtttgcttaatactttcaatctctgccttctctttgttccagatctccatgagcttggagacctcctcctgcttcgtcttcagcaattcttgcaacttctcacggcgttctttgcttgtgacatcggtctccttccgaagcgactcgagctcgatctggattgtggtaacttctcgatcaagctcctggatcgcatccggttttgattcttgctgcaggcgaagagctgatgcagcctcatctaccagatcgatggctttatcaggaaggaaacggtcggtgatgtaacgattgctgtaggttgcggcagcgacgagagcaccatctgtaatcctcacaccgtggtgaacttcgtatttgtctttgatacctcgcaagatggatatcgtggaagccaccgatggctcgccgacctgaatgggctggaaacgacgggctaacgcgacatccttctcgatcaaccgatattcattgagggttgtggcaccgcagcattgcagctcgcctctagacagggcaggcttcaagagattgcttgcatcgatacttccttccgccttaccaagcccgagcagagtgtgaagttcgtcaatgaagagaatgacgccaccttgcgcatcttctacctccttcaggaccgccttcagtcgttcttcaaagtcgcctctgaactttgctcctgcgatgagcgaaccaagatccagcgcaacgacacgtttgttcttgatgctttctggcacatctccgcccacgatacgttgtgctagaccctccaggatggcagtctttccggtaccagccgcgccaatgagcactgggttattcttcgtgcgtctcgagaggacctgaatcgttcgatggatttctgcgtctcttccaatgacgggatcgagcttcccagctttggccttcgcagtaagatcaatgccatattgctccaacgctggcttttccggttcaccacccaagttcatccggtatgtaccgcctggaggattcggtcggccgttggcatagtgacgagagatagagatcgcaggagaaacggatttcggagaagagagttgcgaccgaaaagcttgcccgaaacctattctttgcacggccgggactctgtacgacgatccaagggtagacggccggcacagccggctccgagagatctgtaaccttgtagacatcatagtcgtgcaagaaacgattgttatggttgtaggaagaaaagaatgtacataatggtggtagattaaatacttcaagacttaataacaagatcggtgctatctctcggccagtcggcgagcgttctggaaagctcgagcctttgagtggcgggagctccgtgccaagcccgtctgggccggatcacgtgaacagccccccttagggcgaaggaggggcatccacgccgcttagagaaaattctccccaaaattaaaatttagacacgttggactccctttttgttctccccatcctcccaccgctactttctgtctaacgtgtcctctctttctttagccactctcgatctagttcacaatgggtttcaccgactttacctctgacgctggccttactagtaagctatttaatctcgttcacttcttgcctgtctttcagagctaggttaaccatttccccaagttgccaacaacttcctggctaccaggagctacattgttgggtaagtgtgcctgcttcctcgtctaactgattacaatatgaatatgatttgcgcgcttcgcttcttcttcgttccatgatgagaaaaaaaattggtccgtgtttaggaggcggcttaagacaccgccgcatgactacacccaattgcgagaaatcgcatctctgatctttttgtcgtccttgtcttgcttgtaaaggtcgcatttggaataatgaggtgctgacgaaatccttagctacggcccctcccaggccgatgttgtgaccttcaaggctttcacgggcgctcctgacgctgagaagtaccctcacgtcgctcgctggtacaagcacatcgcttcctacgagtcggagttctctaccctcccgggagacccttctaagccttacactgcctacgggcccgagtcgacggagcttccgtccaacccgaaggagaaggctggtgacgatgatgacctcgacctcttcggcagtgatgaggaggaagaagaccctgaggtcgtcaaggagcgtgaggctcgccttgctgagtacaagaagaagaaggagggcaagcccaaggaggccgccaagtcccttgtcaccctggaggtgaagccatggggtgagtagatgtcatccagacctggtagcatgaaccacggttggctgaccttttttcagatgatgaaaccaaccttgaggagatggaggccaacgttcgcgccatcgagaaggatggtcttgtctggggtgcctctaagctcgtcgccgttggttacggtatcaagaagctgcagatcaacttggtcgttgaggacgagaaggtctctctggatgagcttcagcagcagattgaggaagacgaggaccacgtccagtctaccgacattgtaagttttgctcgagtcggtgaccatctgagcatattctaactgactcaaacaggccgctatgcagaagctgtaaacgagacgtttttttatgacctaagagagatggaatgatgaggatggactgtgatgcctttcctggattatggagtatcatgacctttatttttatctagacagtgaccagcgtgtagagctggtcagatgacgaaaaaaattcaaaactatgcacctagcgtgcttacaaagacatttttatgaccccgatttattatacataaattcttcgctatcagcaaacgaggtttttgacgtgagagtctttttgctcccagcgttgtcgtccaacttgagcccgttgtaaataccccaccaatcgaatacgattatggtgacacgctcccgaaggttactccatacacgccacattggaaattgctgctcagcaataattcaatttttatttaaaaaaaaagatttgtcgaaaaaaaaacagccaatccatgcgtaatacatccccagtttcacagttctgaaggacttccgagctcatgttctggcaatcacaacggtcttagttgggtgttgaatattgcgcaatgcggtcttctccgcatccgtagtacccgcatactccgtaggacgtcctctgaacaggcaggctgcatatcaatcaaccttgaatagatccgatcccagcgcggcccttttttcttatatttgaagtgtggttgcgaacaggatcccaattgattgctcagatccagctgcctaaaagcagaggcgcagagatctgattgggaatttgatttcaatcacctcaaacatttatttcaagccagctcagctgtcccgaacgcaatggggttcttttcccgtgtgatcacgttttttggtctcattttactagctcatgcgtgagttctaccttatttcccttattactcgttactgaggacgatgacatatactgacgacatctcgcgaatccaccagcgcctactccgcacacgagcactcgactctgtacagcaatgccggacgctctcccgcttcattgtcatcgtcgtcatcatcatctctctcacctgacctcccgttagatatcacgattgagacgcttgtcgctgtcgtcctggtctcgatcggcctcgttctgggagcagagaagctgaagccgattacctggagcgcgtgggcgggacagattgagcgagaaggtggtcggaagaatccataccgcgggcttgagcagaggattgggttttgggatgtgagggtgagttttgattcacttcagagtctccttgcagttgaggcctgcggtttccagttggacgaatgtttttggatcgatggaattaacctggtgctgaccttgtctttgccaggcaagtcgaaaggaattcgcagattggatgcgcagtcaagaagagtcgacttcgactaaggggtgacacggattggtgctgctgctattcgtccaaacagcctggccgatcgattctcgcattgtacagtacattatgtcgacacgtaatggtgaaaagaaatgaagtttcctatgacaataatatttctacccaacggcaaagatcggtcgatggaggagccatgccgtgtagcagtccgaagggagtcattacggtagccttcggaggtcgacgtgtacctgctgtgtgtttgaccaaacctacgagccagcagtcatgctcaatcagcggtctgtggttcggcacaagagactcctgcccagtttcggaccggaggttgatttaagtgtctgtctatagcgcagcttttgtcaacgattcgtgacacctgctgcagccttaacacgggcatgaggtagaaccattaacctgggttgaattggagtacctggagttctaggactaggctagcaacactgcaacagcagtcctgaaaattgcacatgcaaggtcattgccatatcatgtgacaaaagattgaagatcagaggccgtccataatatggcagcatcagcgcacaaattaccaccaggaccaaactggtgtcattggcaccttcgttggctgataatcatccctgatagggaccaggctgattgcatcatgctttgtttttttttggaaactgtgttcacccaatggaaggttcttttttaagcctcatgtagcatctctctcccgctgattattgctaagtctagatgcaaagaacaggatagatgatataataaacgatatgaatcatatgatagggcatctaggtggtcggaaaatacctatgagtcttccactgtgcttggcccttttggagaaactatacactggtcacatgtactccgtgcataggatgatagagttaaggaactttggacttgattagttgcagatcaacatcgtcatctccgcatacgtgttgtgtgtccatgtaggagggggaaagacctggggaatatatgaggaaatatatatataaatataacttcggcatttactgcggatatgatatccacatgaatacttggatgccattcaattttcggcacaatccaattccaattctgcatattttctcgccatcatgattactaacaatcaggtttactccgtgaggactccaatatgtacctaggcagatagcagcactcacttatgtactctctacatatatcaccgtcctaagggtgttagcgagccattattaggccgctgctcggaccagcagagacacggcaccgttctgcgccacgggacgcctaattcaaattgagggttctatggttgcttatctcagcagctcagggctgtgtgaccgccagcagtgtagctatttttatcacatggcaacttggccgttggcaggaatcaacaaccagctcattattctatcgtgtccataatagctccaccgctggttctatggttctgcggtctactttaccgcctactttttgtactttaccctggacaacggaagcccatgttaataagactatcggtcgccatcccccacagggaggcgacactcgcacgtacgtggaccaaccacgaagtctagcccatggacagcaggtccaatcgcgtctgctagaagattcctgttgttctcttctccaatagtaacaattgcctaggtaccgaggtacctcccctacggtaattaggtaatttcagtcgtggagtcacttgtaatgtacggagtaccctgttacactgtactttggccatgcaccttaatttctagtgtacctcatgatgttgatgatgaaagaaaaatgtcaggacccgggtaacaatgaaaagagtgatgttattcttaccgatggtgccatcgatctgatacgattcagggcttttgtttcggggagcaatctcaaacacgcccgaatcatctcatccatgtccagggcaaatcttaattaacgtgaagctgtaaggagattagatagcgatgcagttattattgcctgaggccctaagaaagaaagggaaaaagaaagggaatcttggctgcgagtggcttgatcatgatcgttttggagcaatattattacctggtccccagggacctatagccgtgcagcacagtggcatatgactggtccactgactgaggtgtcacgagaagcagcatgacagctgccgtctcctgtgttcgcaacacaagcccttccctactcctgccttctatcatgcagttctcctttacccctgcgttctgcaggtcctttctataggtctcctgtgtgtatggcgtctcgttacgattatctagccaagagacaacccattgaggctcttatggtcggtgtaatacaatttcgctttcgaaacgggttgtcgtacgacagctgcatcgccccgatggcgacaccgatggcgatactatgctcagcccaaacgcgtatgcggctagcgactaggacagaaggatagaaacgcgcagatgaaacttgtcgaagcaaactaggccgcttacgcaggctgaacagcgccacccgggcaggaggatcggaaaacgaatcaaggtggagatccacacactaaattgggcgcggggggcgtgcagggctgggatcttgtcgtggtctcgactggaccagcagcgaatgcgagacgtcaatcagagacactctgctggctcgtatgggacaaagccaacaaaatgctggcctgcggaggagaaacatggcccttggcgggtggatcccatcgccagagttgcctgtccctggccataaactgacatttgcaggggatgtggcagggcacaagcattgctaggttgttgcactggacaactggtcctctgatttaaaggcgaccggactccagcatcgtccacttcctctcctcagtcccttgacaccagtctcgacagcagtgccgtgaatcagtcatcaccgaggtcgttgcgagccttatactacaagaaaaacattcaagatgcgctcctccatccttaccctcgctttctcggctgctgctcttgcccagcactctgcgtctcctagtgaggtggtgagtatcgcctgagatcggtctgattgtgactaatttcgctgctctgtagtctaaccccgctacccagtacctcactgagaccaactcgctgggtgccgtgaccggccagccggaggtggtgacctctcagcccgctgttgtcacttctcagcccgccgtggtgacttcgcaacaccctgctgcctctctgcctgctggcgtttccagcatcccggtccaggtgccctctgctagcagcttcgttaccgtggccagctccaaggctgccgcctcttcttctcaagcgagcgcctccgctactagcagctcgagcagctctgacaccactactgcgtccagcagctctgagactggctcctcttcttcctcttcttcttcttccaagcctaagtcttcttcctcttcggccggtgctgccatggccaccgctggtcctcttggcgttggcctcgtcgccggtgccgccgtcgctgccctcctgtgagcggctcatcccgcaatcacctcacttcctgctgtactctgcatgataccatgaagtaatgagctggggggttttgtggttttgggatttggacaatttcttgtggtggttcttctcttcttaggcaatagtgccatacaattcggggtgggcttgtcctgctcccggattcggtgcaacaaaggcatcaattcgacaggacatagtccatccccttgtgtacatgcatcttttcctgtatacaaaagccaatagtaattttaatgaagggttaatgggttcctggcttgtttcgttgttcagagtaagggtttatggtattgtcgccgatagttcggccataactgcaatatggtataaaatgtagccaactggatctcttcgtaggcattccgaactggatcctggcggaaattcattgtataaacctcaataatgagtatttttccttgcatcttgctgctgtgattgatagagaaggcaagggatgacagcgccatacccgtctaggtaaagtaattagccaggcaaacaacgcaaacaaccaaaacgcgaaaggagcgcgtcgtctcaggtgactttcctctttcggcggccacggacgcgtaaggttgttgttgtccgtatcaggactagcgtctagaccgtcctggcccacgtcagaggcccaaaacaaccgcttttcccgggcaacctgcgcaataagcatcatcttaactatcatcgcgatcttatcctgtgctaatattatagagcttcgtgacgtacagcaacgaatactatttaccgaaaattgagccgcttatcttattttgggattggttgtcgtttgagacagggaccagcagcatctcaacgaccaggacaagcaacgtgacctagagagctcgtttacatatatttactttcattgacgttgcaagctgcaacgtcaaaactcatcatggtaaggacataatcacaatcgtgaaaacacccaatacactcgataacaggatttacctgtttatgcgaaagctaacgtcgactatgatcaggtctcgaacttgcgtcgcctcgtcgcggaccatgccgaccttcacaattccgaccttcctccaaattaccttttccccagctcagatgcacactcttcggcaggcgacgacctaacccagctgacggttcttctgactggaccgtatggaacgccatactcaggcggtctctggcggttgcatctgaaaatcccggaagactacccgcagagcccaccgaaggctttctttaaaacccgtatatggcatccgaatgtggaggaatcgacgggcgctgtgtgtgtcgacacactcaagagagactgggagcccaagttgacatttagagatatattaattgtcagtatccggagaggtcttgactgtcatagaaacttgctaatacttcttgacctgatcagacaatttcgtgtctcctgatccatccaaatccagactccgcattgaactcggcagcaggggccttgttgcaggaagactatgaggcattcgcccgtcaggctaagctcatgacgtcaattcatgctccgataccaccagaaatgaaagaggcggtcatggaagccaagcgaagaggcgaagatccacaaatggcgatccgcatggaggaagatctgcaaccggttgctgttcgcaaatcgacaagggcaacgtctttgatcatgaaaaagaaacccacccagaaccaggaacggtcgagtcaaggcgaacgagaatcccatgagcagggttcggtggccaatgtttcagacgacgaggacgacgacccggcgatagcctcaaaagagaacgatccgtccttatccccatctccggtgaccatcccgccgccaagtcccaggaaaaatgtcctgggaaagcggccactatctgttctagcaacaccgattgatacggacatagtcatggctgatacagacgagacgatgtatgatggaatgactccttcagagaagaacatcgcagcgaacaacagcaatacgtcttcacagaggggagacggctcctctccgaggaagtctccgaagttatccaacctgagcagcggtcccagcagagtaccgtctccaaacacgacaacaatcctagcctcgagaactggtgcccaaggatcttctcaatcgcaatacgcgatctacgaagacagccatggaagccttaccaacaaccctaacaatcgctccgtgagccaggggaaggagaacctgggaacgagcctgacgacgggctcaaaagagccagccgcgggaggagtcatcccgaagaatgctggtacatcatcgtcgtcatcgtcatcatcatcatcatcttcctcgatagccacaaaacctctggcacctaataagatcaccaaaccgatctcaggtcctccccgcaaggccgcttcgtcgagtacgaaagccaaacccagagttggcgttcgcaggctttagctttggtctcagcttgtatattgttcggcctgatttccatccatcctgcttactatgacactcgttcccagcggtgcaaatatttctttttcttttttttcttttattaggcgggcgagaaagacggaagacaaagaaagggaaagacttaatattgatgacgacgttgacgattttgatgatgatgacgatgacgacgatgaaatgatgaatgaatgaatgaatgaatgactgaacgacttcatgacattggaacgaaagacatacagacaaacctggcgatagaccaaagacaacaaaaaagaaccaaaagggataggatagattagaccagtgcatttctggatgggacatggcaatattgggatgcaggttctctgtatcctttaccttcctttaccttcctttaccttccttcccttccccttccctttcattttcttttgtttttgtttcgttttcgttattagttaattccacgagcataatcgattctggcatcatagatagatagattagatagatagattggaaggggccattatcgggagagtatgattgggattaggattgagattgggattttggttacataacttaggtctgactctgcggtttgcttgactactattatacagtactatcacacaaatggggtatttcttttttgtttaagatcccttccttcatctttggaccgtcaagatggctgcattcatgcatgcgttcattctctgcgtctatcctgtctaccctactcttctctgctctttgaaatcgacacagacagcaggtctaatctatatatccatgtgtccagggagtaaaaaaggttgcagtcatcatatctagaagatgcaaatcacccaagcgaagacaggggtaatgtgttgtagaacatatgcaattctctaaaaccggtgttattgtttccagaggattagggaaaatagcacctttgcagacaatcttcctccatcactataattttgcaactcaatacttatacgttccgtcctcctcctttctctgtcggttggacgctttctcccacacattctaatcaattgccctttcccatattcaactgcacgtccaagcttgtacaaaaaaaattctctttttctcttctttccaccggcataacacctgtctccacaggtggaacaattaaacgcgaccagggctcatggaatctcttccaccgaaaccgtcggtctgagggagtatgtaaactggacaaacgaatatcacaggaaagataattgaaaaaaccactagaataggcacaaagattaaaaactggttgattagagggataagcaccgacaaaggtaaggtgtcgagacggcgagtgtttatagaattacttatatcgactatcacatgtaggggccggttcgttcggtgagaccgagatgggcgtgaccgagggtcgttgcttggaaacagatatacatgtggctgacatttcatgcgtggcttcacaaggcgtaggggttcacggaccgaatggtcaagcatctatcatcacaggtcagtatcattcactcatcattcatcaagggggcctttttttttaggcacgtacggagggctcttggttagatcagtcttcagaatgatcggcacacgagtcatctcggtcacatcctgaatgtattccccatcctcttcgcgaagcttgaacaatttcagatacttctctttgttcgtcaatttggcctcaggagtttcactggcgctgatggcaagcttcgggtccgagcgagtgcggtgaggagtttgttcgggttcaacgggaccattccgggtcggcgatggaggcatgctctgggtcggacggtccacggaggagttcagagaaacgccagccgccatctcggtgacctcagaaatgtcgtcatcatcatcgaaaagagcatccacatcgtcggtcgacatggtgcccgtttccgtctgcttgcgctgggcttcctccctctctctacgctctctggcggcctcggcctccgcggcggccagagcggcacgggtgttggttgcctttggacgctcatcctcgggaatataggccgacgacggcacgcctttctcccagtacagctcaagaacgcgctcttccttgcggaactcggctttcttcagtggcagctggtcacagtggacacgcttctcgaagccgtattcgggaatgagaacgtcaaaagcggactcgtacacacagataacaactccctcgctgataaggtcaccgccaatctcctgcctcttcttgtccatcgtgcggcacgcctcaatgtgcacactctgctcttgagcgttgtgggcggagtctttcttgttgttacattgatccgctgtcttctgaagcgcttcgacatcttcagtgaactcgacggccccatttgacagaatagcctcgagttggcgatgaacgatgatgtccgcatagcgtcgcgaggggctagtgaagtgagtatagatcgggaggttcagtgcataatgctggcgctggtcctccggcacattaccagccacgtagtacttggcacgttgcatggacttgatcaaaagggtttccataccctgttcaacagtcaattaatccgattgccccaaccagactggcgccggaagagtgcctcttaccttgcgaagatcagcatcctccaccttgaagagactgcactgcagagttccgctgctagtgggatcgatctcgtaaccaagcctgttcatcctctcgacgaaggtctggaaacgacgagggatgggcgtagcttggcgacgaagcaatgccttctccggcatggcagcgaggagcttgcgagcgacgaagaaattcgccttgtggctcagctcctcaaacaattcatgcgcgggggacgagtcgaagatgttgcgctcaacaggcaaattctcatcgtcaagcaggaacaacagccggagagatggagggttcggtacacggttaccgaacctcgcttccttgaacttggttgcgatcgcctggaattactggtcagacaaaaaaaaaaacgagctctgactgcatctaatatatgcagtggatttgctgcatcaggcctggttccatataagccagagcaggtgcttgaccagcttcatattcaattgaaaacacctacaccaccaggcacatcctatagcaatcagtcatctagctggactgctgagacaccaaagaatgctagggagctagagaagcagtcagagctaatcaagcgtctttggcggcagcatacgcggagtcctcccagtccaattagtcaagcagttgatcaagtggtcaagggctgccaaatcgcgatgaataatgcagtgcttttagagcatgaaatcaagcagctacgtgtggccaatcaacgtcaaaaacgcaagcaagagacagctagatcctatattgctaccggggggattttaactgctgaagaaggccagcagcttgctcagcaagctgcagaattgcaggcagaggtagctgaccaagctgatatgcagcctagaagacgtgcaccaccgcggtgcagcaactgcaatattcaaggtcatactagggtcagctgccctagtaaataggcaattattttacatgtaaatagcttcaatttaggggtggtgtggtgagataattagatatctaataataatggcgttggtgggtgtttcgctcggtgatctgtttcgctcggtgattgattacgttagagatatagactgactaagctggacacggcaagtccagccgggaggattcaacctaaacaaataaaaattaatatgcattttttaatatattaatggattattcttattggcggattgccctcttcgtgaagcaagtttgcagcggtgatgataatgattgagtagctgagtggatagatcttatcgagattaggtagattgatgatctactgctgatctgctgatctgctgatcactgaggtgtctgtcgaatacgctatcgtattcgtctccacagtaactacttcgtactacagctagctagctaggtcagcctcagcatcgcatcactcctatacaggatatacggatatacatacggagtacaccccacttttgctggctggctatgttaaatattatgattggttcagaacagctatattcctcctcactattggtcggaattcctctactattcaagcttccctaggtaccattttatcagcttttaacttgcttgctcgcttgctagcttgcaatgccaagatgtagtatctctacggagtagatcaatttttgcgactgagtttgagttcatatcattactattactaaaataaatccttctttggatccacatcacatcagttagttagccagctagcttccagtatagaattagaatatatatgtgtgtatgacatagttgtaaattcatttaattagcgagtttttttgagtatatacaagttaggaaaagagcaagtttggctagctggctggctggatgctgcagacctggcagaaacaggacgcaagggacagacagacagacagacgcattattaccagaaagaggtcatgctccaaaaattaaaatgtctatttgactgattacagtgacataccatgcagtttcaattaaaggatagatagatccacgagaaggtctgttgattcgaggctatcgacagggctgagacaaatttcctatatatgtacagtatgtacatacagtacgtacagtacgtcataggcaatatgacaaactccagttgttccaagatgattacgtatgtatatcatattatatatatacgtgatgatagcctagctggctatcatctatctgcctgcttggctggctgtcagtcgatgacagacatgtccatccaccctctgatcaaacccatcgatggatctgtgacactagttgtgcaagatggagccagcactagatacatcgtactgtacagtacatgaacaatggcacttcacgtcacatgcctcgaatgttctcgtctggggactaaagcaatggcacgcaactaacttgacggccctcatttcggataatccttcacatggtagctcttcagcttcacaaactggtcgaatccaaacctgctcaacgtcaccccgcgtcccgagttcttccagccggtccaggcgaggtcctatcaggagtatctgtcagcgaaacctgtttgaagcggcgagtaatgacgtgcttaccgggcttggatagtcggccctgttgataaagaccgtccctgcctcgatcttctcgatcagcttctcggcagcagccacgtccttggtccacacgctcgccgtgagcccaaactcgctatcgttcatcagccggacggcttcttcatcgtccgtgaccttcatcaccggaatgaccggcccaaacgtttcttccgtcatgacgaccatgtcgtgcgtgacgtcggtcagcagcgtcggccgcacgtagttgccctccgggggcaagtttttgaacgtctcgttgtccggcgtttcgtccttggcgcccttctgcagcgcatcggcgatgtgcgccaacacggtctccttggcgcgcttcgagatcaccgggccgatctgggtcttcgggtcgaaagggcctccgacgcggtacttgctcagcacgttcttgacctcgtgcacaaactcgtcgtagatgctctcgtgcacgtagacccgctcgatcgcgcagcagctctgcccgctgttgaagatcgctccgtcgacgatctgttcggcagcccaggccacgtcgacgtcgcttctcacgtatgcgggatccttgccgccgagctccaggccgacgttgacgatgcggtccgcggcagccttctgcacggccaatcctcctgccacggagccggtgaagcagatgtggttgacaagaggtgaccggacgagggtctcgatctgcgcaggggatccacaatgcaggtactgaatgacgttcttggggaggccagcttcgtagaaggccgatgccacctgctcgacgaccgttggcgtctgaggagagggcttcaagatgacggcatttccggcgaggatggcagggatcaagctgttgaccagaataaggtaggggtacttttgcagtgttagcaagcaaggcagtagcacgcaaagcagtagacaggaacagcaattctcaacgcgagagacgtacattccatgcaaagatgatcaacaccaccccgacaggctgccgcttgatgtacctcttgaagcctgcctctgcctcgccatgcacaatcccctcttcaccgagaatcgagccgctcacgcggttcaggaaggtccctcgcttgacggcggtggcgatctcagtgggcgtgtaagcgatcggccggcccatctgctcggtcagctcgcgcgccaggacatccttcttcttctccaggatctccagggcgcgcgcgacgatctgctggcgctgttcgagggtggtcgactgcgagaacgagcggaaggccgcctgggctgtctcgggcaggacggcgaggtctgccggtgagatggccgggcgagtcaggacgggggcattggtggtgggggagatggtcgtcagaatttccgcagacatggtgatgagtagtcgaagatgcagcaagcagcgctgcagagattgcaattgatcgagaaagtagagtcgtacagagtctatgtggagttagataacaaagcccctccacgttagctgccccgcggtaccagagcggctccacctgattacagtaatcggtacgcagtatactatactactacatgcacttcgatatgattcaacatatgaaagccactttgcgatggaactgctacattctactacaacaatctgactccaagatgagatacatgcctgttccaccaacgccacacaatcttgtaacgccatctcgaagcaacattaaccaaagacgagtcaatcaatgccagtaacaacacctctgtaatccattccttccgtcgtctcaatctcaatcacctactcatttggactcccgtctgtcactcctataatatctttgtcgatttaatcctccaccaccacgcgtcgcggatctgggatcttcatgctcgcccacttcacaaacatggcctcccagttcacccggggacgaggcctcaggaccatcctctggaaccgccgtcgacgcagggtattgatcgtcacatgtattttaatgacttcttcctcctcctcgtcctgggtgatgtcactaggttgctggacgggagaatcctctgtctcagacttctcagactttgtatcggatgattcagattccttggtatcgtcttccaggattgtagcttccaccgatgcagtagtagtagtggtatgctgcgcagtctccgactctgactgacccggttgtaattgcgataccttctggtcctcttgcatcgaaactccagcggactcctcttgttcttcttcttcatggccgtcatccctattctccttagaagaagaagaggaagatttccgaactggcaatgattcaggcttattcttcttcttcgcatttaatgaattctgcttcttttccaaaagaggtttccgcttctgcgccttcttcttcttgcttcctggttgccgtttcatgtgcgtgatgatcggttcgattcgtactgtctcctgcgtctcctgggtctccttctcccgtcctggtgagcgactccgatgttcaggaccttcaggttcagctggctgctgcgagtctgaatcggctgcctggtggttggcctcctccgggcttttttctgcaggcttcaaggagaagatgagtgtgccaggggacctgcacaagacgaggtcgttctcgtacgcattagcattggttgttctgtcttccttccggctttcttcagcagtcgtcgccgcacgagagtcaacgtccgcgtcgccgttctgctcattcggtccctcttcctcctctgcctgcaagacggtttcggtttcgtctccctgctcgtcattcgcattcaacgccagttcggccagctccttgcccgtctgccagtcaaacagctgtttgttgcgcaccatggcgttgtatgtcctccggtccgcataccgatagtagctcgcctgtctcgtcatcgtctcccgggcctcgttggcgacggtttcgatgtccaccttgatggcgttgcccagcttttccaaaagagtcctgcgctccttggactctctggcgacggacgtaggcgtaggaggctcaatgccgagactgctcattacgtttctgatgtgaccgatctccaatgccgcagtagcagcagtcttcgagctcttcaccagatgatgatcttcctgctgttggatgcgacgctctatctgtatgtctttcagcagggcttggttgaccctctcgcggtcggccgtgctgaagctagctgctgaatactcgtgtatcgcaagctgaatcttctcgataaactctgccgtcaatcccggggagactggtcgtagcttttgcttgcgcttcagcaccctggcgagttgtttcgcatgcttagcggcgcttcgttggtttcttgtcgacttgcgaagcagcggcgacggtgacgagggcagcgaggaggataatgatgatgatgatgatggctgagactcgtcattcgactgcaactgcaacaagtcgtctatgctcgcctctgttcttgcgtcgatatccacccagtcttcctcgccttcgtcaaggccagcagacgaggaaccgttgtcattgtccatctcctggatctctctgaccaatgtcccaatctcgcggtgtctcttgtcatgttgttcgagtgaatttcgacaactatatacaaacgcagtcagcatagtccagtcacccaaagcctgcaacgcccgaaaaaaaaaagagagagagaactcacggttcacacttatgcgaacaacccagccggaacatagtctgatggaaccgaacacacggttcagcatgtttcccaaagcaagtaagcttagctcgaggattgttgagacacgtcttgcacaccgcacagccgtgtcctataccaattttggtttctttgttagcgaagacccggtccgatccataggtaagcgacaggggataagggtatacgtactcaacgccggactatcctcgaatctgtactcagaagcagaattcgagtacttggccggtgccatcttaatcttgcccttcaagcaatatcagccaagcaaagcaacagtccacttcttctgagtcacagcggatcacgtgttgatagtaatagttcttgtgctgcttggttggataaagaaagaaagaccttgcaaggcaggctcgttgcatggatagatgatccagtcaggtacagtccagttcatgtaaatctgtgactgctccgctctgcttgttgagatagatggtcttcttctcaagcagactgttcaaagggttgactgactgtgaacgagagtatagtaaagagaatagataggaagtaggtagaaagatgtgcctctacgcgaggcaggtagtaaagaaaagatgaagaagaggatgcggaagaggatgaggaagaggatgaggatgaggatgagaaacaaaaacctccattatataggaaggcaagaaagtaaacatatccgttgctgtaagaaaccgacacgctattttcatctctatgggacaagccgtcttgttttgatatactgtattctccgctcttcacaggacgggaagtaccgctgctgctgctgctgctgctgttgttgttgttgtcaggatcacactgttgttgtagttgtgggggaatgcagacaaggggcggagagagccattcatacctacttaccttaggtacttacttgcacatgtatgtatgtatgtatgtgtgtatacctgggtaggtaggtaggtaggtaggtgcgtaggtaggtaggtgattgttgtgatgttccatctatctacctgacaaagcaagcgttccccattgtccatcagggaacaaagcgtgtgaacagggctagttggtactgctacatcagcatatgcgtttggtaagcaagcacacgccagtatcggtatccacatcccatcaaaactaattacagtacctcgaataggtagattcctacgctattgagtcgagtaaggggactaggtatgtacatccgcgataccagatacgatcgatattccattcaattcaattcagtaattggaagattacgtctagaccaaatctgactgagggtgatcgaaaagaaagacagtaataactacctatagaacgtacagcgtaccattgtttggacgaagtagatgtgcctcatgtctgaaattaaaatgaatgtctttggatccatgaccatgactacgagttgatagagcaggcaggtccttgaagtacggaataagcaacaggaaacaaaactcaagtattatattatttgaaatctctgtccgtccgtctagacggcgtatcgcgtgagcacagtagatgtccttatctgatgcgcattagcaggggggaaaaaaaacaaaaacgatgtaaaaaaccgttagcaaatccgtcaaccaactcaattcgacaatcgcctttggctagttgactgactgactggttcatcagatcagacatcccgcaccagacgcgctcctgcccaagcatagggatagttgtgctggtaccagttgacactgcagcaagcgcaagtaattagcaagcaatagatcccttaaccaaccagggcccttttcatacttacaatgtcgtgcggccagcgattcgagggtgagtagcccacgaaccgccaaggacgatgtagtgctttccatcgaaaaagtccgctgcatcagaccacgtattcagcatgtatgaccaaaaaaaatgatagagaaaaaaaaggtttggcctaccagtataccccggataaatctccattgcctcaaacccctcatgcggcgtcagcggcgagctggtccattcccacacgcctcccagttcgccctgcccggcgagcttgtcgccctccggggtgacggggatagggtgccagtgtttgaatccgacattgcagccgtcgagatctataaacaccggcatcctatccgtggaggaggaggagggctgcacaggctggtggtctggggctcgggacttaggcgggtttcgttcatggtaggactcgcccacgtcgtctgtatgagtatgaccatttgttccgttgctgatcaatcatatttgcaagcattagctcagattttgcaaataatagacacagacgccaagttacacaccttttcataccgccatttgtcacgtgaagcacgccattctctttgctggctgccttcatggattgcgagtatttatagatgctcttcacctcctcgaacgtgggcagtcggcaattcatccatctcgcgtaccccgccagttcgtcgtacgacgctatcacgggccagtcaagagcccacaccagaggcacggggccgaatacagtacgcacggagaacttggagatgaaatcgtcactggcatgcgattccccgtttacatgatgatgatgatgatttccattggcagcgccgtggccgtcaggcgcactaaccatccacgatgctgggatgtcacggatctggttgacctctaggtactttgcatactcgccgttcgtgatcggccggccctgggcctcgaaagccggcacggtgaccactctctgcggcttctcattatcccagccaaacgactgctctggtaccttactgtggtccacgtcgtgcaatccgatcgtgaacgtctgctgggggatcgagaaccatttattgggctttgcatttttccgagcctcgcgtgccatcccttcaaagtctggcgtgctgactccaggaggaggaagggtcctgtcgctctgcagcagcatgtagaggaaggtctctagatgcatggcctcgtgctcgaagccgacccaaagggcttccccaagaagtcgattattcttttgcagcccgtccgtctccgtcttcatgatggactgcactcggcttcgcactctctcctggtagtccaggatctcgcccagtggcggccattcgtcgggtatttcactgtgggcgtggcactgctcgggattgtcgacatctggatcgatccctcgctcaaagatgagctggtaacttttaggttcggtcggtttcccacgcgttccccgggtcaggtggatatctgtcatcgtcagcggtatcaagggaccaaaaaaaatgtacactcaccgagaaaagtgggtatatgtcccaggtagaaaatcaacgcattccggagcttgataggcttcgatagcagctcttcctgcggggtcatagacttggtcactatgtcccaagccgtccacagggatctccactcctgcagagtcggaacactatgagcgacatactctcgagggtcagtgggcaaggaaaaggaggccggcgaaagcatatggatatctacggagtgtgtattagtaggtttggcccgtgcgtgttcaaggacgatcgatcagtcgatcacactgtggggaagatctatcttatcatagctccaagataaggaaaggatactcacgataatcgttagaactgttcccgaacgaagcggcagggaccagccccgcatcacgccacaatctctcgcgctcatgcagatcatacttaaacgcttcttcaaagaggatcttctcgcccttacgcaggctgatgccattgatagtgacgtcctgggtggggacataaaatgcttggtggcagccattggcctcgtcgaaggagcaaacgacttcccactgccccggcttgaaggcctcgtagcccaggacggcattggcgtgggacagcccgttcaggtagaaccgggacgtaacaccctttgaatcgttgtaagcgcggtagactttgtctctgtctttacacgcatccagaccgacgatgaccgagtccgatgagcctaggagtctagcaaatcggcccaggaattccgccgcctcgggacggcggaagttcccaagcgaagaacccatcgacaggacacacgtgggctgttttctattgtccgggttctgcagccagctcagagcatcgtcgtacgtgccatggaggccatggaaacggacgtgctggtacgtctggggggagatggctgcaaacgtgcggttcagttcctccagcgagaggtcgagggcatagtagtccacctctttccggatcctctcaaattccttgagcaggatctcgatcttacgcaggttcctagagctgtgttaaaaaacaatctgtcctgagaataaaaaaaatatcgcccggtcggaacatcaatttggccagtggtctccggagccaggaaaaacacacccactacccagctcaatcagctgcgcattatccggcattctctcggcgatcgtcctcgcatgagccgtcaagacctcaatctcggcattcgtcaggtagtactcgtccaggtacgtgatctcctcgaacagccgaagtccccgggtgtcgtacagcaggacggtgggaagagacccgtgccttgccatcgggagggttgagactgtcgtagattgcattggctagcgacaggcccgaggccttcgggcggatgtcaatgatgttgacagtgttctcggcgaggagtgcaggagacatgctgagaaagaaatacggataggcggtagacgcagtgattgtagacaaaactgaaagaattctactgagttacaaagccagacgcaagctcgaacgaacaatagagtgtataagtacgcagtataagtacttaatcgattcaaaacggccgctgatttattctgtttgagcactgaactccagatcggaaattttagttttagacttctgccacggcaagaaaactaggaaaaggaatatggaatcatcgcgtcgacaagtgatcaacccccacagccgtggaacacagtcgagtttgtctcgaacaagcacgcgggaccatggttggtcctttcaacccttggcagcatgatgggcggataactttgatgcgagttgttgacgtcggctgcctacctaatgccccagggctccaggctcctgcggggcgccttttgtcatggcctatggcccatgggcccctttaccttagcttactacctatgcctcgagtggagaagacaaacatacccagctaggatacgatcgtgaggagatccagtcggcagatgtcgtaaggtatgtaatgcaaaactcccgggatcccgcggacagccgtgttgtaccggcatcaatcaccattgtgttttcgtcctatcgcctgcacgaggcagcgggagttccagaattaaggtacctaaaggtaaggtaaccatactgctatttgcagtgttgcacaggccatggacctagtcacctaggcagggccagcaggggcctctgacgacatccaaccacaggagaaacatcgaggcgatggaggagcttagctgcggggagctgcacaaaacaggcagtttgccttgtttgccttgtttgtttgcctgcgcaggagaattactaagtagatgcttgtgacgttccaatgacatcccagctcacggctcacggtgtctgcggtgttcgcgaataaaacctctgcattcaatctgatgtttttgacggcggctttctcggctgaaaaatacggagggcacatgatctgtcgtcgtgaagttgaggcgtggcttgctgactgctgaacatcaagtctcatgtgtatgtactgtacagtaaatataggtacatgtacttggtagtaatggcagacctgcagaagatagctggtagtcatatgagtttggacaagcatcacgtgcctggctagaaattacacccgctgctgcagagacgatccgtgtatcgatttaattgcaagctgcactctccttgtctctgattcgtcgtaatgtcattcttcttcaaataccacgattacggaaggagaaacgtttgatttttagtattcatgactaaattcccaagacattactgtagactctagattatataggccagaacatcactcaaaggaatatcccaaacgtagctggcgacagccatacctcccacactcattatcgccgccatcaagacattgacgccattgttatccagcaagtcatatccgctctcgacgcgacggctctcgcgctcatggccctcggtgccagaagggccgccgtggcccggtcgtgatcctgccgacgaaccagtcgctctagacccttgcagcgtggccgtgttgaaggccgactcggtggctcgaatgctgctgctgtctcggtccagaccgctgttgacggtggtagaagattttgtcgaggaggggtggataaggacctataaaaaccgttcagtttctctgacaatcatagtatgaattgtttctgtacacacctttcggccaccgctgccctcgacaatcttgccagtccgcttatccaccacactggcctggagcagccctccaagaaaactgtccacaacactgcccagcccgccccacagcgtcaccgcaaccacccagagggcacgctccttgagtccccatccatatagtccatcactgcagaaaggaaggagcaagagggacgtcaccgcaatggtaaaggcgccaaaaagccccgccagcagacccgtcggagtgacgccgccgttggtgccaggcggaacgacacgtaaagtgggggaggtgataaggcgcggtttggacttggaaagaatccccaattcagaggagaaggtatccgctgcgacggcggcgtagtttctaaaacagaggacagtcgattagttatttcactctctctataacataacaaaaaagacactactcacgctacaatccccacaaccaacaaatcacccacatcagcaccgcacgagaagcaggacggagaggacagctgcaaccataacaaccgtgtatgcagcaatatcagcaccgacgcgacaatcgagttggccagcacctggatatgcgtccgcgcgccttcaccgccgggcgcgcccgaggcggacagagtcaattgggccttgacgtcgtgtttgacctgcaatccttccggttagagctaggtcatatcaccgcaagtggcaggaagaaaaactagatagttaagtatactgtacctttgtcgcactcgtcccgccgagataaaacactgccagcaggaagaaaggcgccgaccacggatggacgacgtggacaatggccgtgaggacggccgcaacgaggcccgcgggagtgagggacttgcgggaccaggcgcggtagacgagcgcggtgaccgccggcacggcgatgaggggcttcatttcagccttcagcctttgtatgcgcccggagaaaaaactataatttgtggcttcccttctaaaaggccctttgaaaattatgttaaggaaaaggagataagaaggcggaaagacaagaaaagagataagcggagttctcctgtgcctggaagctaagctaccgcgtcattcattattgccgggtggagcagccttagcttgtccatttcgggtaataagcttgtttccagctgccaatattaaaacacttctaatggtaaggtgtatacgtttaccatgacatcaatagaatttcgatattgactatataaagaggagtaatttccgttttatttttaattgtataagtacgtgcatgtatgtactgttcacattatgttatatactgtactacagcatccaagcaaagaacatcagtcaaactggatctgaagggtatctttaaaaattcagcactgatatcaccaagagcaatacctcatggcgaggatcatgaaacgtggcgagatgaaaggaccagagctgccaaatacgagtctgtggtagcgtattgatgtaccggccatactgtatacacatcatctggctgcctcgctcgcgtagctatgagatcacgtctcgtttgagctgaaagagacgtggcagatgccagatacatcgaactctgctgtcccgacctctgttgcaactggccaactgtctcgcctgacctcgagtgcccacctgctcccagggacgagatgattcatgagtttccttcattctagcacaagaacctggggtgtggcctagtcgttaagccagataccctctgcaggctaggttgcacgccccgggttcgaaccacggcagtgatggttgagggggtgcggtcattaccaatactttccaacatcaccacgggatctggccttggttgtagtaaaaccctgcccgccgcaagcaaggcggggttttcgtagcatcctcactgagaaatcagtgagggtgtgagcttttttttatatttctccatcatgtctggtcgacagaacgtgtcatgctggtcgtattgctggtgatcgcgtctcagatatcaacagcagggtaataaggacaggtcaacccagcttatccttcccggctgattcccgtcgagacgcaaatatggtcacagcggtatgaccaagctttttctcagccaatcaaaccagtatttatttccccctcttcacagatggaacccaccatgctcagagacgtcgcagaatctccacaggccggcctcctcggcagctttcctcacactaccaagctcctcatccgtgacagcgcggttgatatccgcatagcgaacaccaccaccaccagaatcggcggacgagtcgtctgctgctgctgcatcgttactgctgctgctgcgccctcgtttcttcttgccgacatgcgcatctggatgatactgctccatgatatgaacatacaaatccttggagacattctcagccaaccacctcatgatctcccgtccttcatcctccttgcccggcatgacgagatgacggaggagaacgcccttcttggcgatcccatcggaggtgaaacacaggtcgcccacctgccgatgcatctccttgatgctctccctggctgtctcggcgtagttgtcggccttgagcagccgcttcgaggtgctgctcttccagaccttgaagtccggcaggtagatgtccaccaggccgtccatcagttccagcgacgccagcgaatcgaaggccgaagtgttgtagatgatggggagtttgagacccatgtctcgcgcggcgaggatggagagcgcgacctgcggcacgacatgctcgggagtgatgaggttgatgttgtgcacgttcccgacctgctgcagcttgatataccactcggccagctcctcgggagtcaggtcgaatccatttcgttggtgggcgatatcctatcgtaatcaattagcaccaaaggaatttcaaatgcagagagagagatccctacatgattctgacaaaacacacaccgcaaattacaccccgaaaaaaacaccgacccactcccattatacccctggatacacggctcctcgccccgatgcggcgcaatgacattgaccttggccgtctcggcgccgatcagacacacgcccgtctgctcgtaccgattgacgccgcagagccgcgggcagaggttgcagttgcgcaggtgcgcgtaggcgagagaccgcttcttggcgacatcgacctcgctcagtagttggtaccgagggatgtagtcgtcgaggaggaattgcggtgggattccgaggtgtcgtttgcagactcgctggacgatagcagtagcagtagccgagggagaagaaagccgaaatgctcgggagagaagggccatggttttatgaccagtgttgaaatatcatatcaggatcattgagcactccttaacaaacaagcagacaacatagttaataattccttccgaccaactcttctgctttgatagtactccgtaatcaataaatggttaattaagttcgcctcatctggacggacggagaagagtgggtccagcatgaataactagttaactagttaagtacgatataaatcttacataagcaggtacagtacgccgaatacgtcataccacgtgaggccacaatagccatgaacagacagattcaatgacaacgacaatgattacctgcagacccaaatcgactatgggcggaagtacacacctgcaatcgaggtaaattccaatttattatattgatattatttggagatttctaaattacgagaccctactactacaaagggcttttcaggaaatgaaaagttcaagaaaaatgggctgttgattatctacaagtatcctccagttatatataaaaaggaaaagaaaacatcccatagaatatgtactgtgcttactatacaggggtatttccgtaataaacaaaaaataaaaaaagacaaaaagccagttgcagcgaaaaaaaaagggcccaccaccaagttaacccaactcgacagattccgacattaatttgtccttgtctcgacgccagaaaccgccttatccaacaaaagaaaaaaaagccataccaacattataattcaagatggcgggaaaaaaaatgtgagttagttaaagaaaggggaggagaagaaagggagagttgtccatttgcatctttttgaaactccaaacccgggccaccaatccaattgcataggtatataccatcatcactaaccatcagagtcatatcgatcgtttgaacagagacgatacacgctcaaaaaagtcatctgtcatcataacgcaaggccggtcccatcaccggtccagcggtagagagcaagcacttctcgtcggcgttgttgctgctcgccaaaatcttccgagatccgtccgcggacctgcgcgagagccgatcgcatgaccttgcggaaatttcgctgcgacgaggtcagaagtcagcacgttatcaattcctttgatagttttgtccccctcaaaaaatgcatacctggtactctgtattcagggttacgacacaagcttcgtgagcacggacaatcgtctcgcacgccttgaccacgctcggactggcatccccttgcagcttgtccgctgtcagcagcagcaaaaagctcccctgcaagaggtagatgccaaagaaaaacggcataaaactcaggtcgggatcatattccaggatgtcggccgctgcctcggccgcctgcacagcatggcccatggcggtgacaaacgattccgaggaaatccacaggtcgttgtcgtcgaacagagagatcgggtcccatttgccggtcagcagaatatgcaaaacatgcataatgtgcgttccgtatgcaacaaccatcttcgtctgcatgagcgactcgttcactcgcgatcccgccgtactggtcgagcgtccagacggactgacatggtcgacagacgggccgtcaaaacccgcttcagcttcgttgccgagaccaagactgctggtatgacgagcttcgaactcgcgcaaactttgcccgtacacgtcgagttggcgggttatttccgccatctgtctctcccattcactgctgtttcggaaatgcacgccaaaccgaggatggttgcgcgcatgattcagatcgacgatttcgcccagaatggtcatcagcggcaggaagtatccaaacatgctatgccccgtacattcgatgggcggcccggcgcgccgatacccggcgttggcgaaatcacccgcctggaagacatcgtcattcatcggctgcaagaggctctcgcactctttatctagcagagtcagcggtcgattgtagcagagtgcgaggtgacgatccatcacatagagcagccaccatatgcgtctgcgttcctcgcgctcttcctcggtcacttgcccggttgtgctggccgtactgcccgccagcgggatcgccgattgcgtagcatgttgatcgacgtcaccgtctcgctcgtcttgtcggggttgagacgcggtgggcggcagctctcgacccagtttcaactcccgtgccagtgaccaggctgcggcccaccagcgaacactggcagctttgtactcactcgccgatatgaccgtggccaggtggatgtaggtggccacatcatcgatcgctccggccgcagtgctctgagcacccagctgatccatggagacaccaaatccgcccagcgcgacaccgttgatcaccatattcgctgcataattcggggaggtctccccaggagctggtccgtgaattaacggacggagcaaacccacggttacctccaacagtttctggcagatgagtccgcgtttggacggaggagacgtcaataacgctgcatcgctcgtctgagcggcgatccagagcatgctggccagaagagccggactacacacccggggtctagtaggatgcaggaatgattgctttcgaaagacgtatccgacgacgtacggcgatcgcgggaacatatgcgacgaggacgtgctggcaaagtagagctccagaaggtcacaggcaagcgattcgggaatgatgtgccttatatgcgggagaaccggctgcagaacgggatatttcaaggtgctaggaacaccagtgggcatattaaatgatggaaagtttgcaggtgaggggggcggtaaggaaagccatcccggcgactgagcgggcggggtgagtccaatgaatggtgctgaagcatcttcgcctagccggtatccgttgatattcgcatgattctggtcctgcggattcatcaagccatatgtactgttatgaaaaccgctattgaaagtctgaggaagtaaaggaggtggtggggtgcgctgattcgaagcagacgagggcaaggcctgcaacgatcgcagatcgggcatctgcatggaggaacggttcacgtcatgcaattgcccgtagtcgttcatgggcagattttccatgcctgctgccatctgcggttgtggttgcgacgacggtgtttgctgtggtcgtgaattgcttggcaggttggcaacgctccgtgtcggatcgaacgccgagtcgtatctaccctgggcttctggcggggatgatttatccggagactcttgaccattcgtgggggcagaggcatctctctcattggaatgagcattagtcgtactagtcgccgtagtactattattccccgcagtagcagcggcagcggctttggctgctgctgccgccaggtcctttttcgacgctttcccacgcttcttccgttctcgagcatattcgcaggtcagaccgaattctgcgaccgccgtcagcaattgcgggagagtcctccgacgcagcatgaaccgaagtatgagtggaacatcatacctatgcaatgtgcgcacggctgctgcccatcgcatttagtccgcaactgattacattgatcgcaggcgcgactgatccgccggcggacgggagctgaagctgaattcttgcggacgccggaagaacgtgcctcggtgacggaagtccggcgtacagggaccttgaaaccagcggattccgatgcggaggaatggtccttgaacttcagcacctcatcgtgggaagaagaaccggcgttaacttcggcctgtcgcgtgagttgcaactgctcgagagcatactgggaaccctccgccagggtgtccaggccggaagtctgcgactgggaaatctgcgtagaggacgccgccgtgtcagagccggtggggaacgcggtgtatggattcgtgaactgctgtagcgcggcagacatggtctttggtcgatcaggaagatcgaggtcgacataggcagataccagcagtaaaactcacgggcacattgcccagtaattttttcttttcttcttttctgttcttttttttttaatccaaccaccagcggcactctcaacacagcaaggacagagaaatggagcagattcctcccagcggggaggggaggcgacggacgtctccccgccaggccaaggtcaaggacggaggatccgggcaggttcgtcgggagattacacggtaacagcctaacgcgcaatggagataaccgccgacagaagccaaaacgtgcgagaatctaatattggggggtgagagagaatgaaagagggacgtcgagagtccaaagaagcgtgtggtgggggtgaaaaagagagagaagagagagagaaagaccggtagcagttctgaagccgagaccgcgattgcacgtcaacgagagaaggatgagtttcagttcagttcagttcagtccagggcaaagcttcatcccgtaccgacgtaccgacgccttgactgtgggtaagccaccggtgggcaggccggacaggaccggacaggctgacaggccaggacaggccaacggggtcgccaatttcctgattttctcaggacaggccccccggtcagcaggcgcttacggagtactcttagtgtgcagttccccagcactctccgtacgggctgctccaggtatctccgggggagggggccgagcacgcgcatggtccagcggagggatcgggtcttatttttttgttttttcgagggcgtccccaatgggaaggcgaacgcggggcgctgtggagaggcggtggcaacgccacgcacgcggggaaccaactggggagcgatgccgacggtcgtccatcaaactaggccgtgacggacggagccatcggttcctgggagcaccagcaacccgattgagtcttgagatcaagtgaccgttgcgattcccacgaggccagctgccagcagcgaccgcgtaggctgccggatcggcatggagggcgtgcgctggctggttcgcgccttccccggcctgaattcacccttgcagtcggtgggcgttcgcgccttccttcggccgcggggaagaccctggccgctgcggccctgagcttgccccagcacggaaggagcgtccatgcagacgttgagcgattgtatttgtgcacagggaaggaagcagccgaggagagcctcttcatcagtggcgctcttgccaatctgccagcgtactccgtattcctcgttcttgcctttaattcaagagacaggaggatctcaccgctgaaagactgcaaccggaacaggtcgcatcacaccaacaagtacacacacaagtactcagtcgagcactcgtcacgagcgatcaggagatgactctggattaattattattattgacgacaatccccgcgagccaacctgatcgtcctcctctcctgcaatattatttggcccctactctaagtctctaactccgtacgtaaccacaccccatcgatcctgtttttgaaactagccgtctagacttggctcagccgatcgacagcatgtcctaatcgaaaattgttactatattctgtgactctactatcccccttgacggcgtgcagcgtgcagcgtgctaggtggcttcttttcggtcggacgggaggatccgaacaagacgatgacgcggggggacacggcaccaccacaaggctacctacctagacagacgggatcagcaatgaacagctctctctctggttagcaggttgttggttggttccctacctaaattaataattaatcgattaattaatcatctacgcggctgccaatcaggtattcgtagcgcccggtaagctgacataatatactcccaagatgggatggcagtaatattactctatattgctgagtgtacgacagctcaggaaatacacacaaactacgattacgttacgttcatttaccacgtggccaaaagataagcgtattgattgatttttattaattggccgtattttctttctagatcttcaatgacatgggctggtcctaatgatacatgcatgactcttcaaaacggaatgttcccacatatacatacagtacacgcctccaaagaacgcccatcacccggaatcatgtcccgcaaacggcaacagtaggcaaatatatatatatatatatatacaatgatgagaagaggcgctcgaggaggttgtcgttacatgccacgaatcccaagattgatgtcagaacacaagggaatataccggcggcatcgtaatgccatcataataagacaggaatcaaaaatgggacgtgagaaataatacatcgcatcgaaaagaaccccattcgctggtgatgaaaggtcccacccgagaacagatcacccgtgcatgcacgcggtcaagagaagaaatatttactctccttcagtcgcttgacatcaaagtctcccttcatgggaacctctcggaatttcagcggaagccacagccagaccatcttcttcctctgcgcctgtttcttcttgggagtctccgactcatcctcctcggcctcgaggtcttcggcctccatgtcccggcgacccggccccgcggaggcattggcctcggcatcactgagctgatcgaactcggggaacggactcgacaccccggtgtcctcctggtcggcatcgtcgctaccgaaggctgccctctgggcgctctccatgtcagtggggatcgagccgacggcagtctcacccagcgaggcggacaccgccagatcctcatccttcccccccatcgcctcaaagatgctggccggcgtcaccatcgcacggcctcgttcctgcagttccggatcctcggaccggagcagagtctgccgccgatgttcttccaacagctcgtgcagctgctgagcgattcccttctttcggatcttggtaatcgcttttccaatccgcgactgcagcggcaccttcgccaggaacaagtggcccgcatagcgcacccggaattccgacgccaaccgcttgatgatgtcgtcggaatgcatgcggatgaaacagtcccgaaggacagcgttcatcacgtcaacgtcgcacgcatgcgtccagaacgagtcatggacggccgagaaggtcaagcctcgccgatcacattcgattgcggaaagcatcatgtgagtagcatcgagcgagtgaatgaagttcggtgggaaggcctgcagctgcttgcgcttggaaacaaccccgtcggccgttggatcctggatactgaggtcctgcagactggtgtggatacggcgagtcttaacggagcgatacggctggacgacaggcaagccgaggggtgtggtccagataatggtagagcgaaacatcttcaacgggttgtactccctcgcctgagttttcttgttagatgtcacatcaggatcaccttccagaacctcctttgcgagctcttcgatctgggccggggagagtgacgtgctgattcgactggcacagtcgcccaaccagtactggatactgtgggctccgctgaagatagaaccgagggcactgaaaatacatcgagcgatatacttcgcacattcgttgaccggttgaagatccgggtagtgttcgaccagctgtctcttgacctgcctcatggcgccgatgaaggtgacgccgtagacattggtcatcacggtctgcttgacaatcttgcgcttgattttgccctcgagaatcttggcaatctcattgccctccgcggcgtcacgcgcgactttctccttgacccactctgccacgcctgtgtacacgtcggatgggcgatcggaaggttccaggttgacctgttgggcgccctggacatctccaccgagcgcagcgtagtgctgaagcccgttgcatgacccatcctggtggatcggtagtcgagatggatactgtgtcggatccgggtgccggagggcgttcctcagctcgcagcatgctgcgaggcattgccatgggtcctcggctccaaggaaccatcgcctaccatgcaacccgttgttggccgagtcgaggatgtcgtccaggtgctccatggtgaaagcttctcgttcttgaaggctggccttgtcaaatccatagacgttcgcgaggtggatcttcagccatctcaaccccgactcaccgagcggcttgccctctttgaagagcagcagagcccgagcattatccgcgcccatttgattcaggtaagatggaagtggataagctcgaccccggaagtccaggttgtgaggcaagtagaaggtctcatttcgaaacgtgcgagcgatctccatctggaagttcatgaaacacctcgacgaatgaagacccgcccttttgttctcgatttggcgaacagcacggctccactggatccgcgcttcatggtcgtctttcgcaggctcggggggataaggaagatcaggctccagaggcgggatcttggcgatggcttcgcccgagttccacgcttcgagcatgacgtcgaacacgtcctggttaatgacccatgccgtcttcccaagaacatccagaccagcacggatctgctcaagcccgccgtttgcgagagccttctttacgtaaagctcctgaatgtgatcacccggcgtacaacgcatgatttgactttggtgggccaggtatcctccttctcggaatccagtccacggcctgggttcggccagcataggcatatggcgggcgatcaaatgcgtcggcggttcgcgaaagagcttcccgctcacttcgggatgcagatggatcaagccaacccgcctccctctgagcacttcgtacgagtgttgaaaagcgggttgcaaggtcgtggtccgcttcttagtctcgggatgttccgtggtcacagggactttggcaacatcgaagaggagagccatcaaaatgcctcccactttcgcgtggaccctgactggccacaggatagaaggctttgattccttcacctgctgcactagggactgccatttcccacgccctgctctctgtttccgagtctcgagcatcttggcaatcatgttctgccgccgggtatcatcttgcttggccttccgtagcacctcttccgcaatcaattcatcctggatttctctgccgagagtcgtcacgatcgacgaaagcttcaaccctttctcgacaccgccctggctgaaaatgtggacgaggtggaggatagtaatagcagcgagtttctcagggtccatagatcgcaggtagacaccatactcgcgacgctccctgtgcgcaatcgagggcgacgagccttcctgctcggcctcagccacgagttttaactcctcgtggatcttggaaacgagatcggaatgccattggtttatcatcggacccaatttcttgcctccgccagacgtatcgagaccagactttctcatttgttccatctcgtaacgccagcgatcgacagccgactgaattgctgtcgcctccagccgctgctgtcgcattttttgatatgatttgattttttccgggtccgaagtgtcaacatccggcgcacgtagaggatcaacggtaccagacaacaccgaaagcgttttctttaaagacttcaacccctggcccttttgctccaccgggcggacaggggtaggttcggtctcgttattcccaggcagtacctgcagtgaatcttcttccatgttgcccattgctactcgctgcaagtctgcagcgcagatctgtcacaagaagtcaattgcaagaccacttcaagaaaaaaaaagaagcgcttcacctacctctgacaactcgcccagctcgagctcagataaaaccggaagcccgaggacatcctcctcgactccatcattcttagccatttcccaatacctccggaccgtccgatcacgcctagagccgtgtagcatgcgcaacgccatccggatcatgattgcgtacgtcgtcgcatttggcttgacagaagcctgcggcatcctcacctcgaaccacttttgcagcggccaggtcagttcagtctgcctgttcacgatcatatgtgaaaccatcgcctccaaatatcgattgtggagatccaagtactcgggcgagcccggagggtagaattgcaacagacgagtcaatagactgccggcacgttcgaatttgccaactttgagtgaaacgtcaaaattggcaagcatctccgacgcatcacctccaatgccattgattttccggaaaactttcggtttcgtctgtaaggaggtctccactatgacgatggaaggatccctggagttgagatgcgaagaaaattcagaggggacccatcgtacagaagaagagtcattgttggaagcggttgggtaatgaatatcctcgaacagattctggcgaccaggctcgatgatggaattgtctgtagcagtggccaagctccgagtagagagtaaagatggtcggcggcggccaggctcgttggaagtcgagggagccggaccgctcatcgactccggccgacttgattggaaatggagtctcgatgccgctggacacagccagggcagggatagctgctcggctgattggcgtaaatgatgaaacacatttcggcgacgagctgctcgaggtagcatggctgtagaacggaaggttgttcggacgtcgaccgggagagggagaggacgggtattgaggatgcaatgcgcgaagtaattagataacaattatacagaggacaacttaattatacacattcagaaggaacaagaacagaaaaagatgcagaacaaaaaagagaatgactgccagaaggggagagggaagagaatcgagagacgatcgatcctccagcaaccgacaacctctctcacgaccgggagtaagggagagtccagggctctctctcaatcaatgacctgaacttccaaggaaaaaaaaagaaacctccttctacagtggaaagagaggaggagttgaaagaaggaagacaggcagtgttggttctgggggttgagagattccggctaggaaaaaaggaaacataaccaaactgccagagctgcgggagcaaaatctacccgcgaaaaaaagatagcctgtcgcgcgacaccccccggggcccgataaagtcacgtgacatcacaggttatccacttcccctttttttgcccttcgatggcattcgctgctccaccgcagcaccagccaccaataatgagcggtgaatttgtgagttgtgattgatcctcgttcgacggagtactccgctgtttgagagtcgtcaatataccaacaatcctctttgccgttgctactgctgagtgagcaattaatattaatacggtacggaccatagtatgcatgggtacggtacagactcaatcctctccgccgccacctggttgacctccacccatggtttcctgataaacaaaattctgaaagaacggcaataatagattgagcaatacaggtcacggtgagagcatgcttatcacctaattcattagtgtgacaagcctttgaatagagcaagcgcagtactctgtatatgcattcgatgacaggataaagagtaaatgcacacgataatgtgggcagaagaaaaggttctttccgaactcggttctatttagcttctacagcataatacacagtcaagagaatggaaagcctctctgataaatatcattagaagtagccttcaaacataatcggtctattgcatccctcgttgataagtgcttagacattatcgtgtctgaagaagcgggtatcgtgtctatcgtcttatcgccgttcttgcagaaggcgaaggaaaagaagaatgggagagatctcctgcgacagtcctaggcttcgtcaatcacccttctccagcctcagctgtggcgcgcttttgcttcttccgattctgcttcattgcccatcccgtcagctccgggtgagccggatcgactcgtggtgcgctcatctcatcaagataatcttcgccgtcgatcgccgattggagttgtggtagttcctcggggttattatggatcatgtagttctcgtacgtgaaccacgcttcctccgtctgttcaaaaccacattagcatcgatctgttctcaccgctgtggggatctttttatctcttacctcagcgtccacccattcataggactcccacttctcatcctgcattttcttcaagagttcgatattgcctgccacgatggcttctccgccttctgccgacttgaccttcacatcaatcacccgtgcttcggcatctcttggcgcagcctcctcatccccgtctcttttggctctggccggctcttgccttggtaagatcttcagcagcatcgagatgatgaagttggggtcgcaattggacgacagcagaaacaggcgaaagatagagattttctgaaaagcaaagtcgaattagccgtgaactaaacgagcgagtaaaagagagacatacttccacggaaggcccctagcatgtaaagcggatcaccgtcttgaggattctttatcatcccccccaaagtctgcaccttcaatagcgactttgcttggggctttcccgtcttctcgtcatccaccatgtccacatcctcgtcttcgaccttcaccctcgccgcaccgctagacgaattgaagcctccggccagtccgtacgccccgccttggtttgtggcgcgactacgcttcaaggcctctccgtacttgagacctttgctcacatcgtagttcacctgggtgttgatgggaacgtcaacctcgacaagccccgtctttggcttgagccggaataccgtgggcttttgcccgttccgttcatcgtaagcatggcctgtcgggcggtcgacgtattgtaacacatagcgcgagatctgtgagtcggtgaggtagacatcgtaggaggccacgataggatcggaggaagccatttttttgtcaattgactgattgaatggttggttatcgacaggcaagttgccaggacgagcgggagtgggaaatccgagttcgacggaaaactcgaagcgttgtcgcactccgaacaggaaacttcaaacgtcaacctgactgcatgctagtcaagtagatacctggcaagcagatgacggagaaaaatgcaacagcctattttatcggacgttgcccgtccatataattaatcccaatgaattgggactgactgctgcatgcactggttggtgcggggatgacagatgaatgagcttaggtgcccaggtgcctttttttcggagagcttatcgataagcccgcgtccactcgccacacattaaaactaccgcattgaaggcacagcccggcattggtttgcatcaagaatcgtttcgtttccgccaataaaagtgttcataatatcgaagttgcataatccgctgcgtttactactacagtttcactgcatgattggaatgccatttcaaggtagaatacacaagctttaaatccactgcattcgcaaaaggtggaaattactacagattgaacaaaatacaacgcaatatgaacagtacatactgtacgaatccttactgtcagcgcctggaagtcctaagtggtagcgatctcactcgtgaaagagaatgtatgtacggagtacagtacaatacatacaaacaagaattcgaacaaagcaatcatgcagaagcattcataatctgggctctgcatctcatgtgaaactcatgtacagtacatacatacatacattcgacgcaagagctaagctctatctaagtacaaggaaccaggtttcatacatttcatacaagtgaaacaatttaaaaaaaaacaacatgaacattcaacagtctaaatacgacgaaaacatcaatcgaactaaccaagggtgactatgctttttttttcttagttttgttttgtaatagatgctgcgcaatgccataatttactcctcttcttcagcgacctaaaagaattattagccatatgaaacagaaaaaaaaagcaagagatacgaatggccaaacttaccccttcgtggaagttcttcccttccgtcgtctccttgataataccggcgcgaatgcaccagtcaccaaacctctcgggcgtctcgccatcggtcttgcgctcaagcgcatatcgcttgaggagacccttcatgatgtcgaggatctcatcctccttgatcgacgacctgtagagtttgttgagacgctgaccgtgataaccgccacccaggtacatgttgtaagcgccgtatgccttgccgacaaacgcgacttcggcaagccatggtcgtgcacatccgttcgggcaaccggtcatccgcatgacgatgctatccctggacagaccattctcctcaagtgttgcttcgagtttcgtgatgagaatcggcaggtaccgttcagactcggccatggcaagaccgcaagtagggaaagccacacatgccgacgaggacagacggagtccgctgaaggaagtgttgtcgagcttgtacttggccatgatagacttgacagtaggaagatcagcgtcctcgatattcgagaggatcaaatgctggttgcccgtcagacggaactcgcccttgttaagcttggcgagctcgcgcagaccagtccgcatggggaaatcggcggtatcttcaacacgtccgttctcgatgaagaacgtgaagtggttcaagcccttctcatctttctgccaaccgaacgtgtcgatattggacacgaacttgaagggacgaggctccgcgaagcccaatccttccggaagtaaggcctccaccttggctttgaacacatccaggcccatgtcgtcgatggtgtactttagacgggcgtgcttacggttcttccggtcaccgtggtcacgctgcacaatcatgatcttctcacacacaatgtgagtctggtcggcgggtacaaagccgagcatagacccagttcgaggataggtcttcttgttgttgtgagtcacacccataccaccacccacgagaacattgaaaccttccaggtgcccatcagctcccttgatggcaatgagaccaatgtcgtgagcgtagacgtccgtatcgttgtgaggaggtatggcgatcgtgatcttgaacttcctgggaagatacgttggcccataaagaggttcatgatcctgaactgcattacccgcaacttggaccttgttgtcatcgtcgtctttcagccatatctcgtgataggccgtggtggatggcaggaggtgatcgctgatcctcttcgcgacagcatgacactcacgatgaaacccggacagctcgggaagagaactgcacataacattacggttgacgtcaccgcaagctgcgagagtggtcaacatggccttgttgatggcgcgcatggctgcacgaagtttgcccttgaccactccatggaactggaatgtctgtctcgttgtgagcttcatggtttcattaccgtacgcgctgctgatggcatccatctgcagccattgagacggcgtcgcaacacctccagggagacggcaacggatcataaaaatatatttcggctccagaccctgagccttgcgctcctctcggacgtcacggtcatcttgcatgtaggttccatggaacttggtcagctgttggtcgttaggagagatggcgccagtgctctcatcccggagaccttccgcgatagttcctcggagatagttggactgaagcttgatgtcttcatttgtcaatggcggaggttcctccggcacgccttcgactttatcaacgccgagagcctgccagaggcggggctcccattcgttgtaaccagtctggtaaccatctgggtcctggtcatcgccaaggccaaggtccgtgagcttccgaccaccgaggaatgaaatcctggcgtcaagatctttggccggcttgttgtagtagatcttatcctccttgcgaggccagtagtggctgtcacccagaccgaaaacggagtacttaatggtggacaggtcgagatcaccggaggttctcacgacctcccagaatgcacggccattctgagggaattctccctgacccgcagtgctagtaatgaaaaccacattttcctccgtggggagatcttcaattgggtagtcatccatggccatgaccatggtcttcagacctctcgcacgaccgcggttgcccaaacgcttggcgaggctctgggcgttgccgttgtcagacgcaaagagaatggtcagaggagccccataaagcccttccagcagcttctcatatgagtccttggctttgcgcttctgaagagctcggacttcagtgccataggaccctgaaaggttagaagcgaatttcggatgacgcttcatgagctgcgtcagctggttgtctctgcggaggaactcctcaagctcccgtctgatgcgttccgaatcaagagagaatttcggctcgctgttctcgtctttgcctgggttccatcggtacaatggccagtagccgagatccacagccttcttcgtctcctgaaggacggtcaacggggagtcgttctccttgtagtagggcaggtaggccacaataactgagggaccctcgaattgatcagcctcagccatagcctgcaggacctgcgagtaggaaccataaacagccacggaagccacataggcgttaccaaagttcatggcgtacaggccaatgtccttcttcctccgcgaagcatcggcagcggcgtgctctgagtagggctgcgaatcaatgatgagcatgttgacattcgctcccgacgcgaggacgtgatgaacaccagagttgccaaggtcgtaggcccatgcatcagagccgatgagccactgtgattccttgtagaagagctgcttcgattccaggagttgtttggccactttcgatccatcagtggtcagacgagcaatgacatcaggagcaaggctgttggctttggccgggtctcgagcgctcaaagcccaccgagacaaccatttctttggtgtatcggtggcaaagctgttagatttggccgcctcctcaacttcggtgatgaaccgttcacggtgctccattcgggcaatcaatgaaccaaacccgtactcagggctggcagcaaccgtcgcagaaataccagcattgttcgaaccaagttgattggccacgtacaatcggttgccgaacagctgctcgagaatcttaatgtaggcgttttcgaggtggggctgctcgatgcttggctgaggagcagactccttgtgcttgccaatctccaggttctggatgggagactcagactcgaggttgtagagaatgccccgcaacgcttgaacagccgtagatggctcaacgtatccaagtcggtatgcaacaagacgcggcggcttagtttgactaggcgacgtcgtcaaactcgacaggagatccaaaaaggagggaccccacttcgtagtcttgcgagcttgctccaacaccgcaattctctcaatagatctcgggattaggttcgagatctggcttccgacccacggacggtacagacgtgcggtgataatacccacgttcccaatatcggtcttagctttgtcttgctcgagggcatcaacaaaaactccagtggagccgaagatgaagatcgcgaacttcgcattctcaggtccagtatactcaatggtccggtaatgccttccaacggtttcgaagaggacggtccagatctgtgaggtcaagttgaatatgtccgccgcgttgacaggacggacaccagaaccgtcaacacttgtggccgaagagctgacagcatggctgtcagtactgctgtccctcctggaggagccaacagacgagttatcctggctggtggccgaaggcgtcttggacggggaagaaatcgcggcagcagaggcagcagcctccacagctggagacttctctagcccgacttcagggaccaccgcaacccgcccagaatcagcatagagagtcggctcctcggcaccagaagtatgagaagctctggcaccgtccagatcgagcaccttcttgacgacctcgacatcctccacggaaatcgcatcatcatccgccgaattcgccgggtcgaagaagtgaatgacaccctttcccgatttgagcgccagagcatgggcggtcagggcaatatcttgcgcttcttgcagcgtctcggagtgaaggaacgcaaagccacactggcgtatcgagctgataacggagaagtctgggaagggcgacgactcaatggcgacgtggatcacgatggggtagtttgccagacggtaaaggtgtgtaatggcattgaggagcacggaagaagtggtcgtaatcgacacggtcttgcccgactgcagaggatgaaaagcagacagaagaggatcttcattgtatcgaactgctcgcacctggtgtggttattagcgactgaagtagagccgaacagaattcaaggggatccttacctctggcgagcccttcgacacaatgctgctggcattgcgctccttcagatccctaagagtcttggagaactgagagtccgtctgcagagacggctgaacagaaagaacaacatcgctggcaagatatgcgattctcgccactattcattttgatcgcagctgtcagcccacatgaaccgccagggccctaacccatgcgaccaacgcgcatagtcgaacacaaacaaataattgattatcaacaaaaaaaaaaggacatttaaaagagacgcaagacttaccagcttggcccgcagttttaatggaccccatactgacggacgcaggcagcgcttctcaaactgcagcgtagaaggggtggaactatatctagcgaatcaagggccgcggtgacggcatgtattcaaatcgaatgcgttgtgacaaggaagggcagcgacacaacaccgacggtgagcaaagggaaaaggaaagaaaagaactttttgacagaaataatactcctctcagcgacgcttaattagccagtccatcacggggttgaggggacagcgaaaaaatatccttgcgatgcagtcagcgcgctcttccggcctgtccccgggttagatcatctcgattttgattggctgttgatcacgacatcgatgcaaacagcaaatcccggggcatgcaaacatgcccttccgggataccatgcggggtcccgtgacgacgagatcggagggcgaccggcgttgctgtccatcaccgggctatttttttttcttacttgttcttttgctggtgatctcgtcgctagaagagtaagattgtccaaattgaaagaagtaattcaattggaaatgcctgtatgactatgtttgcaaaacgcgccagaggcatagatgatatagatgatttctgacaagtgttttgcatcatccacacccaataactacgtgattgttttctccgcacgagagagtgcccctcggtcgagaaaaccattgggctgtagagggctactactggcgttggccattaatgccctactctcggtcgagaaatgaataatcgcgccactagtagggccggatctgtcaggcagcatgcgggggtaagaatttcccccaacggcaattgaataatgtcaagaccttagaggctagcattgcaactcttactgaaataagacaacccctgcgaagaaaaataataccaagatactatcgcttatccgctgatgatatttgcctatccaatggcatagtatttatttccgatatagatatatcacagaatacctatccaataacgatcacctgtgacgccaaccagtttcggcaagagcccagcgcgctataaatacggcacacgctgttcgcgacctcaattggtcgagttactgccctgaaagacgaccagcaagagtcatcccaagagcttaatgcggcattaagtggctgtttaatcataagaaagagatgagatagcatataagcgcctgtaaccgatccgtttcacaacacccaggccagcaacgatacaagccctataaagaatcacgctggaaagaaagagagagaaagagacagaaagaacatagctggagtagaatgatctatgaccacacagcccatccggaaatagctatgtatcatgcgttcaacgcacatgctcccgaatcctcgactagcaaggaaacgtgggagagatagatagcgcactttggtcgggggagaagatggttcagggagtattgtcaggtaacggcataaaaaaaacgcggcggtgactgggacttggccggctagccgcagccgaattatctgctctcactcaagtcctggagtttcacattcatcccgggctcttgactgtaggctggttgctgcaatgaagcggcttgaagagccgcctgggaaggctgtggaggaccggtgccggaccggcgtcgtctttccctctcagctggcccagagagggatagattgctgcgcttgcggaatctccgaccgaatccgttcatccaactgaaatcttcctcctccgctgaatctggaccaagccagtaatcacggaagacgctggtcatggctcgaccaagcaccccctgccagccctggccctcaggggtgtgggggaggaatgggtcacggtcgatatcagcagcactagcaatggatgtgtttcggctgtgggtgggcagtttattataacgcggttgtgaagcattcaacaattgctggcgtagagcctgcctggcaaatgcaaacatgacgagaacgaaatatacccgcacaagccacagagccgcaatcatgacaatgctctcaaagctctctggttgcatcacaccattgcctaaggtgggtgttccatcagcccttccgccagagcttccggcgggggcactggccgggtaagcagcaacgacggtgtcttccccatcagagaggacgtttccagagaactgcacagaagatacattgtacttcggactggtgaatcctgcagtctcgccgatggtatcggtgccgaatccagaggtaggcgcattgtgatagtgctgtgagacgacaaggaaccatgataccccaaacgcagcggtgtaggcggcattgatgaccgtatctaggagatagaaccaagcgagacccaaacactgcaatggcgactgctttcggatatgtggaaagagaaacaccgtgaggccgagggcagcaagcgagtagatgtacatagacagctgaaccggggacagatggtagccagtcaacaaagcaagcaaaccgtacagtccgctaatcttgttgaggagcaacgacagcgttatgagagaggcccctgtctgcagactcatcacacagagaaaactctgtgccatcatgattcttgtcagcagatgaatagagcgaaagcaggcgaatccttcgcggtgaaggacgagctggactcaacgcacctgtggccgcgggatgcggaaaaagcggcaacccatcttgttgccgcgggggacggaaatatgaggtgctgagaaaatacagggagcgaagaagcgaaagatctgggcatccaggtgttggcgtgaagaggaaaaggtcagcgaaaaaggaaatgggtggtcgtggttcggcagacgactgaccagagtcgaagaggcgggcgcttatgttaacttttgaggcgccctaaaacccttctgcctatccctagccggggctgccggccactaggggctcggatgacgtcgtgcaccaaccgaattggcagcatctcacgttccacgcgaactctggccaagatgatactatagcccaattataaagaatgcgagtgctgtattgtcccaggtactacgacattgtcaattttggtagaatcgggtttggcagtgcgacccgtactctgtgttgcgaggatttaaggcatctagtttaaactttatgcatcaaggataactttgacactaagcctaagataatctgcattatttcagccacatcagatacgaggatcccgtgatcttaacgcttcccagctgatattattcttatgtttttgcctgaaatcaaacctaggggggacttttttagagaatagcactaaatgaatctggcgaatactcaaagaagcacaataaactagctgcaattctaacaaaaaccccctgttaggtagggattatcgcttcgcaagttgatctaccccctgtctccgtgatattattggttgtccgaaattggtttgttgaatttccccaacgcttactccgtacggagtgctttgggtgtgacatatcgctctgctcaagcgactgcagaattgaatcaaatattaactacgcactctataaaagaaccacccacgaaaaggggccctctaagcttgcttgaatcctaaggtggatatttgccaaacaatagcttgacgttggtcaattctctcaagtggcgcaagcagacatcttagcaacccatcacgcagggcaagaatacgctagggaaacaacaacatcaacaaaccatgcttctctgccacgtgaagcctgctgacttgatattcagtcacaaacggtctgcttgtcgaacgggatcatggaagaagtttggtgacgcctcgacaaaacatatccaacgttgctataagaaaacgacaacacaaagcatacgaacgccccagtgccctttttctcggagtggcaatacgattgtcgtcgatattgagcaggaaagcatgaagaatcgaactgagaacccggatacagacaacattagggttcaaaaggcaactttctaggtataccggattcaaaaaaaaacaagacgaaaaaggcgttaaaaaatcatgtacatgtccagaatgaaagacagcgtagattatagacagcagaaaatatgaagacaagcgtctggtataatcgtgtgcgttcagcaggcacatccgtcattgctggtcgtctctctaggagtgatattgacatcgatcactattcagatgagaatcggaagttagttgacctgcacccacccaaaaacaagaaaaatatatacaaaaggaaaacgtactttgactctcccctttgttggcctcaccctccatgcctgggagtgcttgcgctatccgcctaaacagctgtttcacattgtgcccaactttcgcactggtttcaatgaacatcaggccatttctcttggcctcctcctcaccctgtgccgttgtgacctctcgcttgtcgttcaaatccgtcttattgcccacgaggacgattatcacatcgttgccccgttcccctcgaacatcgtccacccatttacgcgtgttctggaatgatttcgcgttcgagatgtcgtagacaacgacggctacactggagtcacggatgtatgaagggataagcgatcggaatcgttcctgaccagcggtgtcccacaactgcagccggaccgttctatcttcaaggtacatggtctgcaatcatgacagaagcggttagaataacgtgttcactctggtcgtttgcgacggagaggaagaatgaggggaagattccccggcgcaaagggaatgcattgttcgcatacttttgacagaaagtcgattccaattgtcgcctgatacgtgttgtcgaacgagtcatacataaaacgcgtaattagggacgtctttccaactgtggcgaggtcagaacggtcgacgtggttgtgtctggtgaaggtaacaggcgacgacgatacataccactctgttctccaaggaagaccaatctgcgcgcgcgttagtgccatttgtctcccagacggaccagaaggaaatgagcagtctggatcgtacttgaacttcttcaaagggttcgaatacgaccccacagcggactgggaagccatggccacgaatgctggtacggtaaagactcaggggggaaagaaatgagcgccaaacagaaatccgcagacaggaaaactataagagaaggcaacgagccagaggtcatgcaaggaagagtcgtatccgtcgtgaatgcagaagcgcgccgggaccccgaggacgggcgatgctggggggtgtttggggtcaagatgggcaagcagctgctaacacatccatggatcccgccggggtttagcggctgcacggggagcgggtccttgtcactggtcggttttcgccgcccctcaccgcccggcatgtgcctggcctctcgttgttccgtgccgaagccagcactgctctgttgtcctgccagagctcccgcctgctccctgcgctccctggttctggagggcctgcacatccatcgtctgtctgctgaatcccattgatgcgggatctgacgtagccatggggctcgcgtatcccgccggcgctgcgaccgtggcgctctctgtcgtgggtgcttgtaagaacagcctccttcccggccacatgagctaggccactgacttgttctgctagacatgctcttccatggcgatggagaagcgttcaatgtatggatcccggttccgtatggttgcgaacgtctttctaagagtagattctaggtcggagaatttcttgaggccgtttctccatatacttgggcgaacattggtattgctctgtgcatagggctttctgtcgttggagcggcttggtacgcgatgaacgggaccgatttccaccagaatacatggctgcagcggctaacattccctgtcctgatgttcgtaggggtatcttcctgaccggttcatccatcgtcggtggaggtgtcaaggcccccaggatacgaacgaagaacctgatctcgatcattttctgtgaagttgtcgctatctacggtgtgattatggccatcgtgttctcgtcgaaactcaaccttgtggagggcgacaccatctattcgggcagcaactactacaccggctatgctctcttttggggaggcgtcacggtgggattttgcaacttgatctgcggaatctcagtcggcatcaacggaagtggtgctgcgttagctgacgctgcagaccctagcctgtatgtttcccacactatgcccttttccaggctcctcgctgacagaggcacaatagattcgtcaggattctggttatcgagatcttcagctctgtccttggcctgttcggtctgattgtcggacttctggtggctggaaaggcggccgaattcgagtaaatgtcgatctgggttatcgagagaagctcctagtgagcgtgatgtaccgactgcggtgttcatcgaacccctttcctatgagcatatatagcacgaggcgcatggtcttttatgtgatggttagaatccgcgggattagcacgaacgatgaaatgattttgcgtcgacggatgacgcagcggatgtacagtatgactctgggaaggggaggttccaactaaatattagaatgcactttttgggttacagatagagagcctatccgtattctagtattaagcagaaacgatgtcgagatcgtagttcggcttggcttctgcggaagtgtccaaggcgggaccaacgacggtcattccgagtctattaagacatgacgaacccgggcagcgtcacaggtccctgccggtcaagtacctcgttcccaacaaacgataaccttcaggcccattaatgatacacaatgtcagggtccaagctcagggctgcagttctgatcgtttccgatacggcatcccgcgatgccgcatctgataaggctggccccgctctgactgccgtctttactgcagaggagcgatcaaacacatgggaagccccggttgtcaaggtcgtgccagacaatgtgctggacatccagcgcgcgatctgtcaatgggcagatggcgaagagtatttcaacctgatcattactagcggtggaacaggatttgcaatcaaagacaacacgcctgaggttcgttgaggccctgtccaccatccgcgcgataacctgctctcaacacattttattcgattctctatctttcttttttttgtgtttatgctttctcagtgttctatatcctcgtctgacaacacaattcttttatcaggcagtgtcgcctctcattcatcgccatgcaccaggtcttgtgtaagacatccttggctttctcagctacgaacacgagctgattaatcaacagacatggcatgcttgctgcctccctgaatattactccatgtatggagaaagctattctggcttcattttctgtttaggaaagtctcactaacgttttcagttgcgatgatgtcccgccccgtcgcaggagttcgaaacaaatcgttgattgttactctgccagggtcacctaaaggtgctaaagaaaacctcgaatcgattatcaatctcataccgcatgcttgtattcaagctgcaggagcgaactcccgagcaattcatgctggcggggtaaagaagcttgaagcggaagcaggagtatctcctgtacagccctcaaatgcaaaccatcatcaccaccaccatcatcatcacagccatgcccataatcatgcccacggacacgctatccccaaaccacatacttccccagaagacagaccacggtccaatgacccgaatgccggacctacaagacgacatcgctcgtctccctatccgatgttgtcagtggacgaagcgctaaagatcatagtcgaggagacaccaaatccatctatcatcgaagtcccggtcaccaccgatctcgttggatcagtgatcgcagaagatgtctacgctggcgaggctgttcccgcctatcgggccagcatcgttgatggatatgctgttattgctcccgagtccccatcgtccggagcaagcacaaagggcatatttccggtggcttctgtctcccacgcacaagcctcgtccatgccaccacctctcgaaccgggcacaatcgccaggattactacaggagcacctctccctcctaacgccaatgccgtggtcatggtcgaagatactgtcctggtttcgaccacaccggatgggactgaggaagcgacagtggagatcctaaccggagatatcaagcccggcgagaatgtacgggagccaggaagcgatgtcgcattgggctccaagatcctccagaaaggggacctcatctccgccgtcggtggtgagataggtcttctggcatcaaccgggacaaagaccgtcaagatctttaataagccccgtgtcggtgtcttgagcactggcgacgagcttgttccgcatgacgatccaaggactctcaccggaggacaaatacgagactctaaccgcccatctctaatctcgtgcctgagatcctggggtttcgagacggtcgatctcggaatcgcccgtgacaccccggcaagcgaactggagcaagctctccgaggcgcactgcgcggtatcagcactgctgctggtgctggcggaaacatcggtggcgtggacgtgataatcaccaccgggggcgtttccatgggcgagctggacctgctgaagcccacgatcgagcgctcccttggcgggacaatccacttcgggcgggtgtcgatgaaaccaggcaaaccgaccacgtttgccacggtgcctttcaagccctcctcggacgactctgcgcagcaagaacgcgagaagaggctcatcttcgctctcccagggaaccccgcctcggcactggtcactctgcatctcttcgtgctcccatctctgcacaagttaatgggcctgggcagcagccgtagccatagcgcagcaaatgcccatgcccgtgccaacaatctaggcctcccactcgtctctgccgtcttgacgcatgcaatcccactcgacccgaaacggaccgaataccaccgcgcaatcgtaacggcgtcccgctccgatggacgactctccgcaacgagcacgggactgagcggtgaccctggtgccagctcgggacagcgcagttccagagtaggcagtctggcaaaggccaatgccctgctggtgctgccacctggagaggggaaaatcgaaaagggccagttggtagaagcgttgttaatggcgccagttgtgtctggggagtagtagattacacatggaatctaatataattgatcccagactggaggacataaatacatgatgtatatcagacaaaaaagccttagacaaaaaaacgccatgcccgccaggttatcgcaatgtgaacctgaaatttgcagtagatatatcgaccatgccatctgtattgtactccgtacgcgactctgtactcctttcatccatcaatcactccaaagcccgaatgcaagggagaaaaaaaatgatgcacccaatatgccgttatgtagaagacaacaggtatataagaactttttctttaaaaaaaagcccaaaattgcgttaagataggcaagctcagtcagaatggcgagtcggatactcttcacctttcggccttccagccctttttcttctctgcccgcagcgctaatagcgttccatccctacctggccgtcgcgcgatctccaagactacgaagcgcacaaattccgggaggacccagtagctgctatgagcgctgagcatgttgagatattggatgttcaggggcccaccgccaccggaaaggtagtagtctatctggccattgtcgttgaggagcagcatgcgcttttcggcgatctcttcgcgtgtgaagtcatgggtttccatctccacattggatggaagcttggagatggcggccggcgcggtcgacactgacttgtgcgaggaactccatcggaagacgctactgaatgactggaaaaaagatgtagtcgacgtcgggatagcggctggcttgagggattcagctaggtcgctgtcgactgctgcattcattcggtaggcaattgctatatgcggaaaccactgttagaattctgactggagcttcaaacaagacaaagggaagtatctcacggtctgtagtgtgcatgatattgtagaggttgtcaagagctaaacaaccgtacgtgtcagcctctccagcgacgcctggttgtcgatcttcgccctctcgacctggcttgtcccttcctcgtcgcggaagtagatttgctgtatgagaatcagctccgatgctcctgaaacggaagatacataggtgatagcaaagtcagacctttgttcaacagcaagaagaacccagctggacttccgcaaaagaacacattcttggggtcgaattcgaagatatcgtcgtgcaatttatcgctggaaaagtcaatatgaggcaatttcgttggctgatggctgaggatatccaacgccatcgcactcccaagagagtgggcgacaagatggaccctgccattctcgtggaacccagggttgttcttgcaccatagccgatatattctgttcgcctccttaacaactgcctggatcattttgggcttgtgatgcgagagataatatgggatatccaacatgacatcgctgatgagcgtccgtatagccggaatagtatcaggggtgatatctttgagagtaaagtggttcgccatcgggtcatcggaatcccgcgaatctatttctgcgtcggcaagggagagagtggatcgccaattgactggaaggaccatgatgcctccatgatcaggccggatatggggccatatttcctcgttgttcagttccatattgacggacctccgaaacccattgatagcatgagtgaaatggaagctttctacccgttctgaaagtttctgaccaatgccatggataaccagcaccaaatccgatggactgggacgcgactcctcaatagcacaagcatagcatatctgctctccacgggcgagatttgcattccttgtttgaggtcgcatcaagtaatgtctcatgtcaaacttggtctgcttggatggatggagtttatcccaaacctgccggttaaagccacggacgacggggatgccaatctgcctccctttccgaatggagctgagaggtcgacgtcccctggagacagacggaagaagacttggacggagtatctgtgcgtctgtcgcgtccacatagatgacgctggagtttctaaagggctttgtttctgtcttctcatcagagccgctagctgcgagattgtcttcaaaggtcaagtccttcttgtcttcctttgccctgtcatctgcttcatggggtttcgtcttcagatcgtgcgccgtcccaggtctgctcacaggcttccgatcctcctcccacagcttgtagacaatcttcatctccgcctcggcgccattttcaacgcagctatttagttcatcctgccaggcctcggtccacgggcgcatgtacagatacccttcctcaagtttattagcaagaactggctcaacaggtaacattgtatttttgtaaaaccacgtggccctaagcacatctgatatgtcatgaagcgggctccaatatatgggtttcatctatacttctatcagatttcttgtcatgggctaaaaataagagaaaaatatgaagttttaccttgagatttggtagttctaccaaatgaagacgcgagacaccaacagggactttgtactgttcagactctccatcggattcttgtgacctgacatctagcgtttctgaagattgactagcttcagccttccttgaagtttctgcagcagcctgactgagatcgggattttgcgtctcgacatcagcttcttggctggcttcccattcacgaaattgaccactatttcttattgtatcttcctcagaccgaggttcagagggggtccatgatctccgtacgggagcgcgaacaaatggagagctaccggtgggagcagttgcaaacgattctccttgagagcttggggcttccacttcttccgaaaatgcttcccctgcgcctggagatgagctactcttccgcttcgcagacttgaacagtcgtccaagaggtgaaccttctcttctcttagaccctgttggcccatgctcatggtccttggtagagacatccgcagagctgctggcttcttcgtggctttggagactagaccgcgttccggatgaccgtacgcggccggaggatgcgcgttcacggagaggtattccggtggcctttcctgatgcctccgacgcctcagcccgtttgtttgtgctctgcgcaagctttgctttccgggcttctcgcagagcgctccatgcttcctccagagcaatattatccctagcagagaaaggttgcggcgaagatttggtctgcgcggaggacgagcttgtggagagagctgggagcggagtcaaaggatcatcaataggaagagaggacgtgtagaagaattgcgcgttgactttcggcggtgtgggcgatgatcgcagggcggccaggtcttccttccggggggcaagaaggcaggtcgagccgtaggtgtggacggggcccgccattttgggttcagaatggtcaagcaactgtgatcacatcagttctgcagtaagtgcccgatatacggaccgcatggaggtgttcatgatctcaaagggcgctggtgtactgttagctagtaaggcagccgtcggagacagacaagcagctagctgtatacggcgaaggcagaaagcctcgagtcaccaagctgcaagtggaaacccacttccaaagacgtctatccgcctcaagaggcgacataaaattgatacctagcaggatagcatggattgccgcataccagctctccagctccgggcaaacaaggagttccgttgctatgaagcgcgcaggagaagcgatgacgtcgcaccacgtgccgggaccactggctctaattactcattcccgaaactaaggtgagaatatcaacacctgcatacttgttgcaacgaaagatactcataaaccatctaaaccatctgccttctatttgataagcttctcagctatttcacatttgacgagcaaaatattaatacagtacagccaaagagggatgctggcaaaggaagggaaaggaacatttttttgtttaaaattgccaaaactcgtcatcattcatgaaagccgacaatgcaagaaaatcgtaatcgtgaggcatgttcatgactgtaggaatgggtatatcattatcattagggggctcgaggcccagatcgtgacaatcatttcatcttgatcatggcatgctccagaacataaataagagtggcagattagtagagacataacgtcaactgatatgctgaaagggtcgagaagacacggcaaactcgacacttatcttcttccaaggctgcgattctgccgttcaacgggcacggccggtgtgtgcgcgagggctgcctttcccatcgcttccttcggagttcttccggcgatgttctgacatcttcacgataaccttcatctgaaggaactcaaagtcgcgcagagtcgcgtcagatgcaccaagcatctcgagaatcttgtgggtgtcgtgcatatgcttgcgaataacgctgtcggggtaacaaaaggttctcacgctcatctcctttgcaaccgccttccagttgtccagagccgacttcagagcaacggggttgatagcatactcgccgtggaattcgaacgtacgaaggttgtacagaatgagttctcgctgggtagcctgatcgaactggaattcgctaacttgagccctgttcttggacatccagaagttggttatcttcttgatagattccgcggacatgcggcgtttatggaactggtcaaggaggaatttgttggcagtcatgcagatcatgacttcgatctcgctgtacatctttgcctgcgtcgggggatccaaagagatggggagtgtcggtctcgaaacgatcctgggtggtgagttgtcctgacgagagtctttcggaaaggctttggccatatcacccgtctggaatatatatgtcagaagatcgttttgcacggaacgtttgcagggagtacttaccacccaatcttccacctgctgcttgatcttctcgcccactttctggagcgccgttttccggtacctctcatcgggttgctccttcatgctcgtagtgcgaccaagccatccgttttctccaaagagcttcttatggggagatctggacccctttttagggcttccgtggaagatatcgatgtcatcgtcgtcatcgtaattcaggtgatttctggagactgaaggtctcaccagaggacgtcctcgaacaggagttgaaggctgagaatcaaccgtgtttttctgctctgagaaatcgaagtgaacatgacgatgttcacgctggtaagcacagacttcataagcttcttcattcttgatgtgagattctgatttggagtgtggaatgtgctttcgaacgaaacgtggttcactctccgaacgggggaagaatctcggggaagaatcgtatgacgagctgctccccatgcctgtagaaagagacgtgtccaagagagcctgttgctcgtggtgatactggttcccatggagagtgttctcgtagggggacggtctatcatctcacgtcagtacaagagcgaacgatgttaacaagcctgaatacttactcatcgcttagcatgataggaacttcctgagaggcattgctgataatgtcggatggatcaacaaaatccgggtttctgttctccgtagaacggagtgggacgttgagaggttcgggttgcagcgaatcaagcagctgtcgagcaataaggcggaaactatccttcgaatcggacgatgaagacgattgactctttgcaggagatgaggatagaacggccgagtctgcggatggttttctggccacatcgaagacattgcgatgctgttcgaagcttgcacgtcgtatctggcgtaggctggcagaggaggcagctcacggttgacgtcgggaaccggccttttgtactgacagtgatggtaagttttcaaaggagtcgatagaaccgtcattctgtcaaattgatatggatgaagatcaaagtggaaagcacagtaaagaaaattgcagatggtgagatttggccagtgtttttgtttctggcgcgtcgctagggagatggagcttcacgagctgacttggttgtgtgttgctcctcgaggatatcaacgctctcccatggaagcaggaagcattcgtcctggtttgagtagagtcgtgatggatgatctttgtaggaatcgtctgaggtgaggttgtgcaagatatcgatataagatgaaaaaaaagaaaggtcgaactagcgtctctgtgtgcaaatattggtggcagggcttcaatacgcatactaacaatacgatagtgatacaaggatccagtcattattcactgcagctcgtccttggagagccagcatgccattgcgatcaatagcttggcattgtttttataatacaatatggtatcgtgctgtcttgccatgttttatttcattcactgcttccctgcttttccccagccaccgaataaaccattggccacattcgtgagaacaatcgcctttataagcagcgtatcatggaagaatcgaagcagtgaatcgtcgactgtggcagagagatgccgccacaagcctaatatcagacaaatccttataggtaccgacaataggaagcagcaaataaacacaatgataattgctatatattacagagaaaatagtggcaatagataactatatatccttagccttacagcttatagagaggattccaaaatagacaaagctctctcaagaaggtatatgtccaaatccagtaatagaggatcaaaaatcctgtggctagtcactcctgctatacctaatactgcctaactgcaaagattgccgttcgaaatctgcatctgccgtcatctactccgaaacccgtcaagtgcgctccaactggacggtcctcgcgcatgcagcttgttctaggcctggaagtaggtccatacgtataacctatctgattaacgggattcctgcagtctgctaaagcccattctactccgtatttgtgtacatacatgcagtatgagactagatctcgctgtgatagcactgtcgaggcagagaatcaaagaatcccttgggcactgtagaagggccggtgacagagggatcgataaactggagcacaagatttggttgtataaatccagccaaacccactggttgaggaatctcctgctcgtccagtgcatctcgtggagttctatatggttaatgaggctattcgatcgaagcaatgagaagacgcattcgggctgagtcagcccgagcgtggtttggggctctccacttgccgagtttctaaccgcagtggaggagcttcatttcgcaacgccgtccccggaatctaataaggtctcgggatgagttacggcattcacaatccccgcacgtaccccagtttgagcaatagcactgcacacgcagcctctcgccatggcctcccaacgtggctcgcccgtgtcactcccgccaattggagcattcagtttgtcgttttctcatgatacgattgccgttgtttctctccgttttctcagccttcttcatggctgaactcaccggctccggggacacgtccctattaaatgggttgtgaaaccctttggctaccttcctcgagcgtcctccttgtccttcattttcttgttctgcgtctactgggattgtctaatttctctgtgtccgattcaccggaccctctgcccattcctcctgctacacgtacctcctcgatggcaagctccgacaagtacgacatagttattgtgggcgcaggccccgtgggacttcttctgtccctctgtctgtcccggtggggttataaggtcaagcacattgataacagaccagtgcccactgcgacgggtcgcgccgatggcatccagccgcgttctatggagatcctccgtaacctggggctgaagcgcgcattgatggcatacgagcctgcgaaagtcttcgacgtagcgttctgggaccccctgccaggcggcaagggtattcatcggactggaaactggcccagttgccctcggtttattgacaccagataccctttcaccactctcgtgcaccagggaaagattgaaagggtctttctagatgaaatagcaaaggccggcaccacagtacagcgtccttggacgatcgtagggttcaaaaatgatggcaaggatgaaacctacccggtggaggtgaatttgaaatgcctcgacacgaacgtcattgagactgtccgagccaaatacttgttcagcggtgagggcgcaaggagcttcgtgagggagcagctggggatcaaaatccactacaaagatcctatcgcgttcgtgtggggtgtcatggatggagtcgtgcggacggatttcccggacattaaggtgagatctatggtcaccacaggtcgccaaagtctgctaacaagaagatcagaccaaatgcacgattcactcggatagcggctcgatcatggtcataccgcgtgaggaaaacatggtccgactctatgttcaaatcgcttcctcgaccgatccggactggaacccgagaaaaaccgctacagtcgaggaagtccaagcggcggcgaagaagatcctccggccgtacagcatcgaatgggatcgcgtcgaatggtactcggtgtacccgatcgggcagggaattgctgagaaatacacgttggatcaccggatattcatgggaggcgatgcctgtcacactcacagcgtaagtatatcctctcgagcgattcacggtcggtgctaactgaattgaagcccaaggcaggccagggtatgaacactgctttccacgacgcccttaatcttgcatggaaaatccatgccgtggagtccggctttgctcagcgatccatcctggcctcgtacgagagcgaacgcaagaagattgcggagaacctgttggattttgacaacaaatatgctaccctcttctcgaaacgtcctccatcggcagacgaggtggattctgcgagctcatacaatgccagttctgtgcaaaatgaattcgtggagaccttcaagtctgcctgcgaattcaccagtggatatggagtcgcgtacgagccgaatatcttcaactggagtcccgatcacccggccaaatcaccgttatttaacattcctggggtcaaattgacccctggacgggcgttcactccgacttcagtgactcgactttccgacgccaatatcgtccatctcgaacaagaggtcccagctaacggtgctttccggatctttgtctttgctggctctccatcgaagaccaagaaagcgatcgaggactttgccgccaaccttgagaaggaacgatccttcctctccgtgtaccgaagaccagacattgcgaacgtctcgtattttgaacgccataaccctcattcaaagctgttcacgatctgcgtgatatatgcttctgagaagaatgccgtcgacttgcagaccctaccgaggatcatcagagactaccatcaccatatttacgcagatgatatccctgatattcgggtaccgcaagccaaatacgctgcgcatgagaagctgggtttcgatcctgagaagggtggcgttgtggtgacccggccagacagccatgtcgcctgcacgatccagctggtggaaggaaatggcacggtcgacgcgctgaacgaatatttcggctcgttttcaacgaagccgcttggacaaagctcacagtcgagtcatctttagatttttttatgagtgtgtttgtaatgaatatgtagagctgatgactgtttcttttccgtaatatcattagtaataagttgttactaagttagcttgtaatattatttttcttttctgacttcaatgtaggcacttatggaggtatttgtgtggtggctggtgtgggaaacatttggtgctgagaatgggcagtatcgttctatgagtttttcaaccccgcggcagtgacatcgccaggcccaaaagtccagacgattccagccaagcaaccccgcaacaaagaaccacgcgtcccagcagtgatcgccaacacgaaatacgacatccatacagaatcagctgtactgcattgcacctagctgccaagaatgttcgcgcttgtgctctctgcagagcttaacgggtgagtaccgattttctggagattgcacctgattaatatgtaccgtaccaagatggattggatttcagattcctgcatcctatcacatccattcatgatactctgtcgcgatgcaggcagaaataaaatccatttgatacgtttttttattatcatcatccttacattcttttggctgactttgaacaactactgggggaataaataatacagagtcaccaacctccgtcctaaagataccgctgaagacccgtactactacaccttcaaggtccaatgcaactcttgtcatgaaacccaccccaactgggtgagcttcactcgctatgtgagtgtctttcccatttcccagagagactgttcactcttccttcggaaatagacaagtcgtttcttttctcttttcccttctgtccttgatgtccctgatacaagcagctagcaaggggagggggaaggaagaaacgtcaattgatgggtttcaggatcgactaatttgatggcgcgagaaaacaggagcagcatgagattccaggaagtcgtggagaggccaactttgtgtggaaatgcaggctctgccaggtatgtctgcatggtttctgacgatctttcctttccttctccttgctattttccaaaaacaaaatggcgattgagtggccaggcaaactgccacgattgaatcccatagctttggaagctcgctgctaatctcgttgagatctacaaactttgtgactcaatgcatttaaactagtgctgaccatacatgatgggaatagcaaacacactctgccgtcataacggcaggacccaacgcgcttcaacaatcggaggacaacaaatccaagggacagaagatcatcgaatttgactgtcgcggtctcgagtttatcgagttcaagcctgatgtgagtgcagtctcgaagtgttcctgaaaaacgaaaagaagtccaagatttgcgtgttacagactctgaccgtagtgacatccgtgaatatagggcgagtgggaagccaaaggactggagactactacaacattctccagcatcgatctctccgagggcgagtggtacgattacgacgagaaggcaggcgaggaggtgagcatcaaggacgtgacctgggagatcaagagggcttaagggcatctctcaatgcctacgcggcctatccattaaaactcccagtcatcggaattcattggtgctattaacgactttgtgaggaagatgctggtgttcctgtactttagtgggtaaatggaagtattatgatgatggggcgaggattcggaaggggaaaaactccaggcatttgaggcgttgaattcgagctgcggatttgttttaccaggaactgtttgtgaaactcatatcatgaatcaaataaattgcagaaaaaagcagatcaagtgcaatatgacagatgattctcactgttattaaacgacgacgttgtgcctgcaataatatccttgccattttgtatgacctccgggcggtgagggaatctcacttctgattggacaactcctcagcggaactcatcctgcgcgcaaaggtattcgcttcgatcccagtccacgcgcgacggtacaagacgagaagagttccttttccagccagcgtacccggggatttgaggctgtgagaagagatttatccttctttttgaactggggattatctctttctcctttttctttcttctccaaagggcgctcccgtggaacctagctgcctacatcatagcttgcccttcgatcgaagagaggattttattatttggcagtgaccaaagtcttgcgcaacgatgagtgttcgttttctccttttcttttctggccatgacctccttctcttagtcaagatgggatattcttgttgctgatgttgtgtgctgactcgttcatttgtgactacagttccaacccgtgaacccacggccttttctccaggccaggtatgccgttgctatccttccctctctttgccttccagcagttgaagaattcgaggataccatcctattcttcttcctgcccagctacatgtgtacaacccgaattggtgttgatgctaatgcgatttttgcagagtcggcacggagatgatcatccggctcaaatggggccagacggaataccgaggcaagctcgaaagtatcgattcctacatgaacgtgctcctgagggatacggaggagttcattgacgggaagaacacgggaaccctgggtttggttctgataaggtgcgttctgtgtgggctgctgccagcctgaacaacatgcttttgagtatagcttgcctctgaatcttacggcaaggctgcaaatatgagatgatccaggaatggatgctgacttatgagtatgtagatgcaacaatattctctggatggctagtgccgatggcgtggagatgaccgacctagggttgaaatagagccatttttttcagaaagaaattcttttttttttcctggttgatggaaatgacgtgctgtgggcacatatacccgctgaattcttcacacaaaggcatgatttataccgcgaaaaaaaaaaaagagaaagaaaaggaatgggaaacgcgaatcccaagagtcactttcaggccaccggtgttttacgattgatgacttcgagttaaaaatggatgcagcagcggaatacacatacgtcctctttttttctgcctcgcagtgacctcgaaggaatatcgagagattccgctgcaaattcgcgaaaaaagcatgctggaaccatcaatgggaagtagataggtggtgtggatatggtcctcgatagaagaaggttcctgttgagcgacttggctggttgcatacccgcacgtgtgatgttagctaggtaataatagctaaaatgcaagaataatactagctggttacatagtcgctaatacgcatcctaccgatgactacttatggatatgccgatgtactgattatttcctgcagcctggacctccatacatttatttttgatcacgtttgtttgtgattcgcaacgcaatagtcgtaagaaaaggacagaatcctcaaattaaatgtgaagcaatacgttccacgagttatcttccatgcgttgaacacgttgcattaattttttttttttgcttcctttctttcctttcttctttacttgtttttctccaggtcaaaagtaggctgaaagtgtctgattccctgtgatatctagagcttgtactccgtattccgtatatcggcgtaccgatacaaaggccggcaactgaaccgtgcgctggaggacgaacctaggttaagtcctggccggttgacggaccgcttctaagaatagcgagccaagcatacccacattgtcccgccttatctgcctacctaggtgggtaggccatcggtacggagttgacagagtaagtagccatcttccgtactgcatggagtacagtacagtttttgactgctattcccttcgctttacgaggtttttttttttgacttaccagttcgtatactctgtccgcctgctgagcgccccccacacagaggcatatccctgatgtcatctcgcacatgatctgctcaccagtcgaatccacgatggcaaaatcaaaaagaccatacggagcaatccgcatagaggacagagaaatcaacgactagcacgagtctcaagacccatcctggtgggcagcacagctctttgatctcgaatctcgatcctggaggcagcctgtggagccaggttgcgccgggatgcgattggcccaggaacaggctgtctccattgatcggcccccttggatgctttgctgcattgcatgcctcgaagaaaaaacgccctccgttgtccaatctccatcgccccaaaagccacaaaggtctcactccgagtcacctggaggggctcgtctacgcaagccggttttgcctctctggctggctggctggctcctgagatacccgaggatcgccgccgtgtcccgatcctgactggtttgcagcatgaccggtaggatgtagccgtatccgagcgcttttttccaacgggcccgtgatgctcgcaggcaaactttgataatccaaatgtgggggatgatcgcgtccaaccagtgaagttatgaactatacgcccgaggcgacgcgcgaagagagaagcaggtagtacttactaagtaagttatcttaccactcagaactcagcctttttctcccagggtggctcggcgactaaatgtagtttaactagctggccagctgcctcgtactccgtatagcaggcaaaaaagttctcctcgtgttcatctccattttcatcctcatccatcaagccgcgatctggaaatgcgggttccgtgaccctagcctctcttttccaactgccttgcgaggcctctcgctataacaccttcaaactaccttactgtcgctagcgatctttgtcgtggtcgtggtcgtggcctctttatcctgtctttctacgactagtcctcactacagtacaactccgtactacctacctacctacctacttctatgactacgccaacgccaaactcgtggcgctcgattccacaaaagaacgaagcacgcttaaaaataatatctgcgtctatccccacctcctgttaactggacttgacgccctctcaccatggcgtcgtccaagttcattgagatcctcgacgccgacgccgacggggcctatcccaaaatctccgactcggacgtcaagctcgaggacgtgctggccgaccacgaagccaccgtcaaccgatcgcgctcgtcgacacaatcctccagcaagagcagtttggataaggaacgttctgatcgtgatgatcaagctcaacaaacttcaccggcgtctctccgactaaggaggttgcgtatattcacgttccctggacgatgaatacaagaaagaaactattgctgttgctgcaaaacaagacctaccgaacagaaccagagtccgcgactcacgaaatttgagcctgattgcttggatcttacgacgcaggaattagactgagacaagagtgccctggtggactgatggatggacgattactcaggatgatgatgatattgatgatgttgatgatggatctggatatacacattctatttacgacctctctttttgccctctgacgacgatacacgataaagagcttcgcatttattattcatttcacgcactcatttttgatacccccttgctgttgtcttgacacacagcgaccgacgaatatatgactatgagagctagctagctagctctggaagcgagacttgagtttggacattggaaccacatggttcaagtttgtgtatatcagaaaggagcgttgtttcgttagaaagacaggaagtcttcttgataccgctcgaaatttgaagatttttgttcggtatctatagatgagaaggcatgccttttttttgctaccttgagtgcaaatacatggggagatatctattcgtctatatggcttgcaacaatatatatatatatatatgcaggaattgaaaactctacccattatcatgcaggagacaaaaaaaaagacatggatgaccccatctcatgatctgactggctgggatcttgaaggaatattaattttcgatttttttttctgaattttaggtattgttagggagttcctggtggaggactactaaatcacgaatcatgcattaatgtcccaatgctcagctgttggcaataatatggcaagccctgccgacactcccctctccccgtccacttcccctcgccggcccctctccgctagagcccccaactgttagaggccgggacgaatgcaccttgtgcattttagttttagctttagagaggcggcctgagcacagcacaattattgtacttgacaggaaaatcgacgatgatacacctatatatggacatccatgcatatctacctacctacctaccagccatacatgtactcttcccccaaattgaacgcctttgacatccatccggtttagtgttgttgcttgggccacatggccacttgaattggcacgtgtgagagcacgtgttggtcagtcgcgtgatgtatagagcaatgtgcctgccttaggcatctacaacgtgcctaggtacctagaacctacctacgccgacaccctattctatatctacctaacataaatagtaattatatcctgactcgttgcaaaatggatgagtttgctcgtctctgcagtcttttcaaaaattagcatctagttttctaattacgaatagctggttttgatcaaacatagcaaccttaggtatccaggtacctacctacctacctgactaggtagctaggttgcgtgtgttgcttttgggatcataatagattcaagacagcaggaatccaaactgcacagcgtatttgaactcgctattgccataaacccgccttcaagtctgaaaaaattatcagaaaactcttcgtgctcagacatcgctcgacactccacgccgcaaaagtctgttattcatattatttggcgttcctagtatctgtcatgtgtttgtggaaatgtactacttcgaactgtccaccatgaatttgtatctgtctataaagagacgacactcacattgttgattctgtatcacccaagtcgcaggctcagctcgaatgacgactagaatgcctgcaaatgcgccttagctacataccaaggctgatccagcccattcagtcgtcgatttacatcccaaccaggctactcgagccccttgaaagtggcggggaaacaattaatgagtagtgccaggggagcagaagtggcccagctttgtttttgttctttcggtcttcctttttccttttcgattgtcagaaattcgaaggtagcttcaaaggcctcttgcctggggaaatttttctcttcatgctcttcaccctccgctggtactctgcccttattgatgcaaaccctgctcaaaagtggcccggagaaaggaccagcagactattctctaaatggcgtccctggaccgcatgtcgatgacgatagaaagctaaataatcacatagtttttgtcaacattcgtcgagccagagaagagcagaatggagcagtgctcgcagagtcaatgatgcagagaagggtttcaacatttaatcaccaaggaaagagacttgtccttacagaaatgcacatcgtccaaacgcgtttcatttccggtttggaggatgaccatgacatagtcctcaaatacagggtgaagagactaactaataaggtaaaggaagaaacagacctaatgatgtctgttcctgatggggcccaacacggacggatagatctcgacgctcgtcacgacgatgatgaatattttgattgtttgatgcagcaacatgtacatacagtacagtttcgagaggctgtcggatgacccctttgaccagtccagtcgccatctcccgagcaagcttcttggatagataaaaaaaatggaggtccataaacaaaatattcatctgcttagactccgactgctgttgtagttagtcagctagtcagtgggcattgaatgctcctgctgcattatagtttgcagcaaatggacgcattgtagtattgaccatcttgacggaccatggaaggatcaataaagaggaagataaggagaggggagtcgactcggcttgtatgtactccgtatgtgtaactaactacctgttaactgactagttaacgtaatcggacaccgagctgccacggacaccgagctgccatgtcatccaccaccaccccctaatcaaattcgatgcgatttgttttcaacgcaccatgccatggctgatatataaaaggaagggcgtagcaattggcaattgaggcctataagaaaggtcttttctcatcaaaaaaggcagctgcagatgcgtttgacgtgcctcgaaggacccttgggacacgccttaatgggaccacttctcgcaaagattcaatggcaaattgtcgaaaattgacagatactgaagaaactacactttcaaaatggattcttgatatggaccgacgtggcctacctccgcgaatttcaaccatacgctatctggcacagctattgctctgattatcctcagatgctactgccaccattggtgagaaatgggtggaccgattcattaagcgccataatgagctttgctctaaatatacccgaaagtatgattatcaacgagcaaaatgtgaagatccagagctcattaaggggtggttcaagcggtttcatgacactattcaaaagtatgggatccttgagcaagatatctacaacatggacgagactggcttccaaatgggtgtgatttcaactgccaaagttatctgtggatcagaaacacaagagagtcatgcaaaagctatacggcctgggaatcgtgaatgggttactgcaattgttgcagtaaatgcagctggatgggccttacctccacatattattcttgcggcagagaattaccaatctcaatggtatcaagctatcccaaaggactaccgaatcagtgtcagcaagaatggctggacaaatgatgagataggccttgaatggcttcagaagaccttcgagacctatacagcttcatacacagttgggagatatcgcctattgattctagatgggcatagcagccatgctactgcaggatttgataaattctgcacagagaagaatattattcctctttatatgccatcacattcttctccctgctccaccgcttgacaaatatagttataggaattatatataatgactagaagttctagtcaactatatataactctatagtgctatatttttcactataaaactattgtgcagggaccagtgtggcgtggtgcggctggaaggtctatggcgtggcttccaccccttgcgcaggttgtttgactgggctcccgtagcaggagggaaaacaaaaattttctttgccggctcacagggggttttggggtcttcccaaccgacaacaaaggggtaatttgaaataaaaatcgagtatgttattaagtttgatgagtagaacaaattggtgtcaaaatcgagttcgaatacccccaaattggggggcgtgttgggagcgcgagagttttttttttggccgtatatataataagtatattatttattgtaattttaaataattaatgaaataataaaaaagtactaattaaaataaacaaattctacctaattaataaaatgaaaaaagttatataatttattatattctaggctaaaacaattattaaagatttaatattttatattaaatattttataaaaatataaagctttaaactagtttttataaatttaagtacttttgattataacatatatgtaactatttatattaataattcattaattttaaactattaccaataatataaaattaaaaaattaaaatttaataaaaaacatatacgattaatttaactttatataactagtaattaaaaataattaacctaaataaaataagaaattatattaagttattttatagctaagattaatataatttatattaaaatatatagctagtattaattataaattatatttttagtttttttaggttctttaaaaattattttttaaatagtttttaggcctagggcttttttaaaaaataaatataattaaaaaaagctttacttaatttaatataaaataatatgtattttatatattaaaccctaaaaggtatagtattataggtaaaacaggttttaggttgttataaaattattaataaaaaaacttaaataaataatatttccttatttattagggtttagtatgtaagatatatattattatataccaaattatataaagttttttatcttttttaaaaaaaaccttagcctaaaagctatttgagtttaaattaatttttaaaaaaaacagtttaatctattattaatactaaaagtagctaaataagtttttattattttaaaaataccaacttttatttataattatactcttctgaatatttatataaatactaattaaataaaataaagtttttatataattattcatattatatatatctacaaaagtattaaacaatatatatttgtaaaaaattatacctataaaatactattaaaattccttagtttttatccctattactcctaatataataattatcttattctttatttaagcatatacttaatatatattctcctaaataagaattctatctccacttaagatatataggaacttattattactccttagaattattaatagactataatatagccttaattactatttaaaaatttctcaatatatattatatctctagtagatactagttttctatctggcacagctattgctctctgcacaattatcctcagatgctactgccaccattggtgagaaatgggtgaaccaatttattaagcgccatattgagctttgttctaaatatacctgaaagtatgattatcaacaagcaaaatgtgaagatccagagctcattaaggggtggttcaagtggtttcatgatactattcaaaaagtctgtgatccttaagcaagatatctacaatatggatgagactggcttccaaatgggtatgatttcaactgccaaagttatcagtggatcagaaacacaagagagtcacgtaaaagctatacagcctgggaatcgtgaatgggttactgcaattgttgcagtaaatgcagctggatgggccttacctctacatattattcttgcagcagagaatcactaatcttaatggtatcaagctatcccaaaggactaccaaatcagtgttagcaagaatggctggacaaataatgagataggccttaaatggcttcagaagacctttgagacctatacagcttcatacacagttggagatatcgcctattgattttagatgggcatagcagccttgctactgcaggatttgataaattctgtgtagagaagaatattattcctctttatatgctatcacattcttctcacctgctccaactgcttgatgtcagctgcttcttgccattaaagcacctgtatggccagaaaattggggagataatacagaaaggaatctataccattgacaaggaagattttttatatatctatcctacagtccattaacaagctaataactactaggtatagattatagtctttaagttttatattagggtctattagtatagtaattagtttatagtcctttataataaacttatctagtatcttcttaatatatctatactaagaaagtctaataatttaattctttctattatatataatagttattcttaagtagtagttatatagacctacgttatataaaatatttacttaaagctttcttaaccttctaaatgtctttaattaatagtttaaagattaagtgactattaatatagatagtaatatatattaagttataatagaagatacctaaatctataaagattagtttaaaccctagtatttttaggaaaatacttaaaataaagtactaaattcttaataattattttagcctatatagtaccttattaagtctatagacttagctgtattatcttttagcctagttaggtacttaacgtaatccaccaccgagctgcgcggaccaccgagctgcgcggccaccacctcggccaccccctatcatcggatttatcgcgatttaccaacgcaccgcgtcatggctgatatatcaaaagaagggcgtatgcaattagcacttgaagcctataagaaaggtctttttccatcaaaaactgcagctgccaaagcttttgacgtgcctccaaggacctttatgacacgcgttaatgggactactgctcgcaaagattcaactgcaaattgtcgcaaattgacagatactgaagaatctacactttcagcatggattcttgatatggaccgacgtggtttacctccacgaatatcaacaggggagccagggagccagaactggctcccctctcctcaaaaaaatgtggtcatcgctggggcagcgctgcggcaggcaatggcagggtgagtgtgaggtgagtagatgaaatggatgaacgggtcctgaggaagcagccgcgcgcgagcaagcgcgggctgggccaggcactaaggggcagccaatgggtcacgtgatggggggagggtgcgtggcaggaagaggggatgggcgtggtgggaacgggcggttagagtgacgcgaaaaatggcgtcgaatgtcgccgtttccggcagctggctaaccgtctcattgatttatagagtagtttctagaaaaaatttataattctctagtctaattatgtttacttattttttttagtgctattcttcttgactatagtattcatatgttagttatcttttcttgtctcatcttacgctacatctgctagacatgctggcatatagcatatatttctaagtatgtcctctcttcaattgtttgccttgtttccttaccgtttctttccttcttttagcacccagatcctcacagttgccgccgttcgctccgttgctaagcgggatagatcattctttatgacgctcgcatcaggcttgtgaaaaccccgattgcgaatacaacagccgcagttgatcgtacaatgcgaaggagtcttcgcctccttacgctgccatccagaagaagatgatgcctggcgtggcttactacagcatccgcaatcccgttcacagcagccgccccgtaatttacactcataacgcaaggcttcgccgaatgtttttcgcttgcgcagagaatagtactctcgaatccaaggtccatcggtccgtagaatatggagagcgaagagccgttgcttggtgatccacaacaaccgttgactgatctggctgagttctttctcccaggcctggagttgctgctgctgctgcgtctcttctttcggagtaagatatgagaaagccaataatctgtccgcctctctgcgttttcgtgccgcctcgacctcttcgagaagatagatctcccgctgtatgatttcattcgtgtctgtcgtctagggttaagagcgatttagcgacccactcccattgcttccgcttctcgttcgtcatccgaggtccgtcttttgtcgaggttccggattgcgtccgagaggcgataccacttgcaagcgtcgaagcgcttttcaagacttcgaagaattcccatttgtggggctggatatcaagacaactttctcagttgacgtctggttttggtcccttgattctgttttatattggtaagactttgtataatggtgttagagaccgcgggtgaatagaatcgcgacagacacagcactactaacacaagtcaccaaatatttctatcagaaagcctgactaggtaccctctgaaggaagcagatagtctggaaatcaggtattcaggtgcggagtaggaaagacaaaccaaaaagggttgcgtcagaattacaagtatatgtacggcgaagggccatttctcattagaagggaagggactcagaaagataagatatgatgatactatcacctgaacaaggtacaggctacttgctgtcaccatgttcagtggtcataattattataattcaagaagcctgtcctatccatctaaaggcataaacgaagagaaaattgaatcatcctcctcctcctcctccttcttcttactaaaaaaaaaggaaagaaagaaaagaaaagaattatcatatgatattcgattttgcaacttgtatagtactaatctctttaaccatattgcatccatattgcattggctaggcaaacgcacacttagaggtatgctcctatccctatccttagctaagactattaccctaatccttggccagtatggacatcttgtagaaatagcatataagaactgaggcttttctagaaaattgggcctacatagtgatcttctttagcagcatggaaagattgctgttcataattattagtgttcctaaataatactaatcattaatagctcttttataggaatcagtcagtacggtcttgtttatcgaagatggaagatcctgtcaaatgtccagaataaataaatcccaactgattagtactaactacctatatagcggagtcagtgagccagctagctacttgcaacaaccatattgaatcccccttaaattacagtacaagggaacttactatttggcttgggattgtcttttattattttttaacaagggagatatgggggcctattataggctttccacccagagtataccaaatgaatactctcgcattgctgctcctcctccttgtatttcagttaaggtatataacctctgcattgagtccggcacaactttttaaaagggatgaaaagagggatactgctattccacattatttattcctccgtcccctaactatccaataaaacggcattatggaagcaatatcatagtcaaatcagaagggggttcagcttcacgaccgatagtcgagaggaggagtccaaatcgattgtaagaagctattaatttttttaacccctagaggttgtaggggataaccaactactacctttattttccaatctatcctctatctagtttctgggtttgatatcgctaaatagctagtgcaagaattaagggagataggtgagaacggggtaaatataaatgagtctgttgaccgaatgagctgctctcctgactcaccctgctcacacctttaaagcggccgtgtccaagtcaggcaagagagagcatctcgcagatttttatacggtattttgacctacctaggtagacctagacctagacctggacctggacgtaggatggtataaaagtaagtaccgtaagtacaacctttgttggtatttaattacctgaggtgtctatgtagctaggtgtaaataaaaaaaataaaataaaatcaacctgagatgaggagttaataatttggatatgcataatcttagagtgcaaaagaaaagaaagccgtctacataggcggatgtactactgtacgagatatagatatataatcctgtgtgtgactagctaagggcgtgcagcaattgtactactatatggcacacacaagcagtgcaaggagatatatagattgtttttgtatagaagtacatactgtgcacctttccagaaataaataaatctatattccataaagaggctcagagttatatataacactttcgaatcgtgcaagcaggtgtcgttgcaaacagcaaaactttatttaaatatttaaacggcaaagaaaatcctttttattgatgatagatatagatgtcagtcgtaactgcatatatatatgatactggatcaggcggtcagcctttttttttgtttcctttggacagtcgttatttatatttattttgttgcgagctgactgacttccaaaagttgctactgtagcatgcgtaaatctgtatttatatttctatctagcctaacagattcacattagtcaatgtgaacgataagattcgagtactgacttagttactgaatcgtcgaggtcaggtccatggatattcagtctaattatgtttgcttgtttccctttcagtaccattcctctcgactatagcattcatgcgtcagtcatctcgtctcgtctatcatccatcgtctgtctcatgccatgccggcatacagccttagatataacacactgcacctgaaaatacataacattttaatcaccagaataaatgctattagccaacaatctcctccgtctcctcgataatctcctccacaatctcctcgaccaccgtgtccggcgcctccgcctccgccttcggcgccgtcttgatcacgtccaccgccacgtcctcctccggcagtcccagcgccttcttctcctccgccagcagctccttctcccggcggacccaggccagccactcgttgagcacccgcttgcgcttctccaccactgccgtgttggcaatgtccaccgcgtacttgtcttcctcctcgaactccttcgagtactcgcgcaggttcttgcggatctgcttctgctcctccttgctcaacagcgtcggcggccgagggcgccacaggaactgcttgaacttgtccgtcgggtgctctgccagagtctggcccgcgaacgtgtggatattccagccgttttccatctgtagacattaattctctgtaaatataatgcatgcagaacttgggttcttaccgaatgcgtccacacactcgcactgctgaccacataccgacccgtcggatcccactcgacatccgtcacgccgtagtgctcaatcgacttcatcagctgcaggttcgccgccagctccttctccgactccggcttctcgccctcaaagtccaggtcccagaagtccaggtcaaagttcgactgcgagtgcaccgtggccaccaccacaaatcgccccttgggcgaccagtagatggcgttgctggtcttcttctcaatcgtgcgcaccagccggaagttgcccacgcctgaacccttcaccttctccggagcgaagaacgagacggccgtcttgggtggccctgctgcccccgtgggagcgtcgcccgtagtgatgagcacgaaccggtcgccgttcggctcccaggcaaagttgatcaccgtgtctttcaagctgtcgacgacctcaacggggacgcccttttccttgacgcggaaaatctccaggttcgtggccatcgacttcttcgacttggagtgacggtccaccttgacacagacgtacgccgcctgcgactgccagtgcagcttcacatcagacacattgaacagattccgcgtccgtacaatctccttggacggtatgctcatcagcgcgaccttggccgggttgttgcccatttcgggtgtccagaagcacaggagctgctcgtagtgcttgacgccttcccgggagggagtcgccggcgcccactcaaagtccatgacgccctcgatcttgaccgacgtcttgtcgagcaggttcatccgtggcagctcgtagatcgaaatcgactgctgcggaagcatccgtgccacgtacttctcgtccgcagaccacttgaacgccggccactgcaccttcttcttgtggcccgcatcgccatcaggaccggagagctcatgggccacgaaggaccgcagaggctttcctgattcgatatcccagatgatgatgtttttgccatcctcttcgtaggtcaacgggccttgttggccttcctccacctggatagggcgcgcggaccaagtcgtcaaatacttctctccgggcgagaactcaatcaactgcacaaacgggtgcgggaactgcttctgtttcgaaaaggtcggcccaccccagagttgcacaccctgcgggtgagtcgaagccaggtacgttccctgcggcgaccactgcacgaaaagctgggtccagtgtggccgatcgacgatattctcgggcgggtccttcttcatgttccagaaaacacccaccttgtcgccccggaaaatgacgaactggtcgcgcgcattggggtcgcccagccaccaccgcaggtgctccttctctttgaacggctcgatgtgcgggggcttgtactcttcatcgatgcgcccttcgcggccgtagcggtcgatatctgtcaacttgttcaccagcagcgtgtgcttcttgtccagaggggttccatggagatgtttgacggcggccatggcctgttcgggagtctcgaactcgacgaacgcaaatctgggggggggggaaattccatcgtcagctgcacaatcaggccctctggcacatcttcaaacacttacccctccgacatgcccttctcgttcatcggcatgaagaacgcatctgcgctcgtccgtccgaccgtgttgagtttcttgagcacatatttgatgagcttttccctgctctcttcagggacgataggcagtccatcgagaacgacgaaagtgtccagaccctcctccagtcggacttcatattgtgctttcagatctgttgcccgggggtgatggcgcgtcagcgagtgaggggtaaaaatttacaaaatttcgccaggaaaacaaacctgagaaatcaatctcctcctcctcctccagttcgtggaggtcctgctcggagagattgtcaaagctgggcgccatggtgggcagactgaccggatgagcgatggacactctggccaaagcaagatctgcgaacgatgcagagggccggtcctcgtccctgtctcttgacgctttgcttagggcaagattaatcgcatcccgtttctgtgtgtgatgcttagtcatgcacccgaacccgcgaggcaaacaaggcaaacaccgccccgacatggagtgccacgtgacacgccgcctggcggatgcctttcccgatcgggactggcgcccctgacggctggggtcacgagatgcgagtgatggctgcttactcatccatctgtcacttctgagagctcccaatccgccgaagctcattgttccctatcttgtgttttgaatgtcttcacagccctgcgcatgctgctgctgggccgcctgcttaagtattgcttgtgagacctttcggattgcctatatctagcttctggtgccgcactcatcccgtgttttgttctctcctcccaactctgcgagctccagcttccatgccccaccgatcttaagcgccggcggtactctccataccttgcgactccaacaccggggtggcctcccacactcctcaatactctgctctcccgtgctctcaagtggctatttcagaagtgagcatcttctcatagttgggagcagtcggcgttttcaattcttttagtgcaatcgctggccaagatgtcgcgtaagtccagcctggttacccttcacatgcgggcaatgatagtgacaggtgttggctccggtagtatccccggaggttcgcgagtcctatatcaagaaaattgatttgatcctcgctgtcagcgacctgaatactatctccgaaaagcgcattcgcaaaggtatccaggaaaccgtggactatgatatcactccgcacaaggttggcactccttccaacctcgttgttttgcgcctcccagtttcactgactgtcacaggctgcaatcaaagagctcatcatggagcgctttgacctctttgcccagaagaagggtttaggatcagcgccgtcggagcaagcagcgccatctgccaacggccaagacggagcggcagacggtcaaaccacagatccctctcctcaaccgtcgtcttccccgcagaagcgtcaggcggacagtgacgaacctgaagagaatgggagcaatacccctccctcaaagaaaagaaagccagatcatgacattgatgcggatgctcttttcgccgccaagcttcaagcggaagagaacaagcgcgcgaggccgaccaggagcagtactatgagaaagactgcgcctgtgaggaagaaggcgaagcctaagacgtcaaagaaagtcgatgactccgatctggagtccggctctgaggccggtgcaaagaaggaagtcaatcgctcgggtggtttccatgtgagtctaaacgagactgtccagtattatattttctcagtgctgattgcgatgcagaaacctctgactctatcgccggctctctccaaccttctaggcggagaagtctcggtaagcatacatgaccctacgcttgagtgtttgctgctaatgtgcaacagctctctcgtccacagactgtcaagcggctgtggcagtacatccgggagaatgggctccaggacccgactgaccgccgccagattcgatgcgacgaacgaatgcgcgcggtcttcaaacaggatcgtgtgcacatgttcaccatgacaaaaatcctcaaccagaatctctattcccccgatgaataaatccgaagagaagttacccagattcaccggccagaagactttgaatgatgtgtacacattttcgtcgctttcccaaagatgagcgactacactcttctaaccaatagaccacccggtcgcatctgctgcatagtgcacatgttctcgttgccattaccgtcagttctgctcattccttccatctatgctctctattttacgaagttgcatcttgttcctagcgatctcccatatctgtgcgtttctctttttcaagcgggagttggtggcttttcacgggcgcttctgaggttgttccctagcaaatgataagatctcttgtagttacatttcaggagtacttattccagacgttctattaattcgaagcatctcaaaatgtatgtacgtctgattccggatcggcagaatagatcatgttaatagcaggagcccgcccagtgtgattggcttgctgcaccaattctagaatcaaccggccagctgaccgactgttgtagtcgttgatgattctgactcaataaggagcagtggtaacatccacaggataatgcatactctgtaggcagcgagcgtcgttgcagcgagccggtgccgcaagttggcctctccgccacggcgggctccctaaacgggttgcgggcgccagcttttccaccacaaaaaatccgcgaagccgcgggtccctccgcagatcgcaaccgtccggcgcataacgctgtttggggcagtattggcgcaggctccgtttcttgagaccttttcttctccctaatcctcaatctgtctatcctacaggaccccaggatcgcttgcttggagtacctacagcgatgagtgaaggtcagggcccagcagcacctccgccggcgggaccgcgaaattcaaactccagtggcggcaggcgacgggcaggacgaggcgcgtctcatcattccgatcgctcagagaatcgcagagaagatggcaccagcgacagccagcctagaggcccaaaaagccggggcggaggtggcggaggtcgagggggacgcgacagacaacggaatcgcagccagaagcccaaagcacaggcttccaatgccgcatctgggggaggcgggcagccaccgggcagtgtccctgatgggccaggcacctccggtgatcgctcgaccggagatgccagacgaacagagagcgaggggaagggcaagcagctggttgcgacagcgacggatgagccggacgacggagagatctgcttcatctgcgcatcgaaagtcgagcatacgtccgtcgcgccttgcaaccatcgaacttgccatatctgcgcgctgaggttgagagcgctctacaagacgaaggcgtgtgcgcactgtcgggtatgtccaagttcaaactcacctgttgctggacattggctaacacggtgtcacttaagaccgagtccagtttcgtaatattcaccgacgaccctgcaaagcggtacgaacagttcacagaggcggagatagcccggacggacgataatctgggaatcaagtacgagcgggaagagatcttcgaagacaccgtcatcctgctccgatacaactgtccggatcgggactgcgatgtggcttgtttagggtggccagatctgcaccggcatgtcaagagcaaacatgggaaggttatgtggtgagtacagtatctgtctcgatggaagtctgtctcaggacggcaatgattgcttacgttggagaacagcgatctgtgtactcggcacaagaaagtcttcacacacgagcacgagctatttactacgtcccagctgcgaaaacatgagaagtatggggacgacaatcccggtgctgctgaccaaagcggtttcagaggccatccagagtgcgggttctgtcgaatacgattctatggagatgatgagctctatgcccactgcagagacaggcatgaacgatgccatatctgcgaccgccggtccggcaatcgtcagcagcagtactttatcgattatgacgcccttgaagatcacttccagagggatcactacttgtgtccagacaaggaatgtctggagaagaaattcgtggtgtttgagacccagatggatctccaagcgcatcaactggaggtccatcctcatgggctctctaaagatgccaggagagacgctcgaacggtggatatgtccacctttgattaccggacaccctatcagccgcagaggcagcgtcgcggtgcaggaagagggcgagatcccaatgcagagccacttccgatttctagtgcccagcccctgagacgggacgaaatagcgtatcaaaggcagatggctatccagagcgcacaatcagtcaccacgcgaactttcggaggccagctaactactactagcaccactcaaagcgcccgaagccctcgcgcggctgatccaaccccggcccaggctgctgctgctgctgctcgcagtccaccggtctctgagatggagaacctcaacatcagcacctattcaggccctctcacaccgcaggagcaagcgcgccgccttcgccacgctgccgtcatagaacgggcgtccaatctcctcaaaaacgatcaactgaaactctcggaatttcgcaccaaggtgtcgaactaccgcacctccgccatctctgcaaccgatctcattgacgctttcttctcattgttcgacgcgcccagctccgagttgggaaaactgatcaaggaactcgccgaactctacgaggacgagtttaagaagaacggcctcctcaaagcctggaatgactggcgggcgatcaacgaagattacccggctttgccaggtcccagtggcgtgcttccggggctgtcgtccaacaccgcgggcgcaggagggaaccgtgttctgcggttaaagtcctcgaccgctcaatcgtcgcggtctgccgtgggccggagcggtgctcttcctgggagcttgtcgtctgggaacccattcccgcctctatcctctgcttcttcttcttccgcttccagaacgacgacatccgcacctgtatggggcactggtactcctgcgtctcgtcccggcgtgacatccagcacctctactactacatcttctcgctctgctccacggaccagcgccccgagcgcagatgatacggaagccttccctgccctccctgcggctcccaagcccaacacgttaatggccggcgtgactcgcggcaccgtccgctggaacgagcatgcaccaactacgaatgcctgggcaaccggtaccgcctcgtcatccgcagcagcagcgtctgccagtgcagcgaacgatgcagaaaccgacgacctgggacccgtgtccacgacggggaagaaaggcaagggcaagaaagggaagcaaaccctgttccactttggataatcaatcaatcaggctgttgaccaaaataaaacaaagcgcgacggttgctcgaatgagcctctctctattttttcttcatgtcgatatttttaatacttgtagcttccccttttttttttggtattgttttggtatttcagtatagagtcagaacaacatagcatagcatagcataggataggatagcatagcgtcgcatagccatagccataacaatagccatagtgtaacaattggattgaggagaaaagcgagaaaaataaaaaagataacctaattgtccaattcccaatggatattcgaagcaatatcttatgtccatccaacaagattcatgccatctaggtaggacaaataatagtcataaatatggtaccaaattattctcattaattcattggttcacacactctacctatgtattctatttgtgcaggtctatttgacgaattcatcctagagcttgaccatataagtaagtaactacatgaacaataataactaatacagctttacttctcagatgaccctccccttttcaatcttcctttcctttctcgaatgcgaagttgttagttgtttcagaattacaggttgagaggtcgaagactttggtcatggtgatcatccagtagatgcgatctccttgttatcatactccagatcctcaactgcctggaaggagtcttgtccatcgtcagtcttaaccgtcccgttgtcacaagcatcgcctgtgaatgcatccgattcggcatcgattgcggccattttcaatgcaaattcctcctgcagtctctccaaccatcttcgcaacgtctctccctccatcgtcccatttaccgcttgcaaaagccgctctctcagatgcaggatcagtcgccgtcttctggcaatcgatagggtttttgatccggctgcgtggcgttcagcaatctcgttaagtcttgtggagaccatctgcgcggtctccaagacctcttgtggaaatgagagcacctttgccagagcaagcccgtagaacttctcctgcacatgaccctcttgaactttgtacagcatggtcattttatccgcctggggggataattgcaccgccaaatgaaggttgacgactccgctacgctcagccataatgcgagcgagatcgcgaaagtgggttgcaaaccatacgagtgcgtggctatcgacaaaagcttctgcaatagcaatcgaaattgccaacccatctgtagtactcgttccacagcatagttcgtctacgacaaccatgctttgagggtcgatgttgcgaaggatgaatgacatttcgcgcatttcagctgcgaacgtcgacacgttggcgtgaatttcatccacagcagctgctcgagcaaatagttgacgcacaataggaaacgacgcataatccgccgggacaaagcatccgatgtgtgccataattgtcatgagcgcgatggaacggatatacgtggactttccgctcatattgcacccggtgatgatctgaaaccgcgactgctgtgccgcataggtgtcgttcggtacaaacttgcctcgatggattttctcctgaatcggatgacgaccagacttgatggccaagacatcggtcaattctggccgaacatattcctgtgtcgtcacaagctgtgcaaaagccgccaacatgtctaaggtggcgatggcttcactgattctgaaaagcccagagatatccgcgcatatttcgctgatcaactcctgaatgctccgatcgctcatattaatcacttcattgtgggcgtcagtgattctctggttcagtttgacgagatccaaagtttggcactcgatgcggtccctctttctatagcagttaatgaaaatatcagggagaggcccctcatccaacccgaatacggagagagatatgtagtattgtcgcgcactgtcgaacttcagatccagcgagaggtcatatacttctatacagagtcaggaaaaacctagccagacagacatgcgaccgacctgcgagtcttgtgaccagctctgtggcatccgcattggcctctttatacgtctgtctcgcaacatcgagaaggctgttcacaccggcctacagcaagtcagctatttttaaaggtagtgaatccagttgaaacatgctttaatggcgtaggtacgctgatttctcaagtcaagtggtttgctctgatatgttacgtcttcattcagagtgccgtcaatcatgtctcgaatcgactggtaaccagctggtgcacacagctagacaatttagaaatcttcatcctatttacttcttccggaagaactaacatctcttatcttcttcaggagtgcactctgcgctccggccagtgcttcatagactgggttgatggacatcacgtatgatttgagcataatgacatggttgaccgactgctccacatggtgaaatgtggatttcacagggttgaggataagctttcttgtcagtacggatgcaatgcactttgagctatgcaaggccactgacagaagtaagaaccttgtccgaatcgacaaaccctttgagagctgacacagaccagacattagtcgccactgcagagtcgattgcatatcttaccttgcctgacagaataaaacatttcttccttggagctcaactcttcaagagcatcgtatcgcgctacaatcttttccggctctgtagagggctgaagaatgttactccgcagcaatctggaacccattggtgtgagggtctcgttgagtagtccgaagagacagtcccgagacttgctcttttgaagattctgtatcaattctaaagaaacgatagtggagagatcaatcatcattgaaccttgagacggttcaaatttgatacgaagagaatggaaagcaaatgacttgcagagctggagctctacgtatttcaggaccttgcggaaaatgagttcagacattaataaacaggcttgagtggacttaccgcagccagacagcatgcggcaaagtagtgaccctccatggagacccggatggactcgatttcttcggggaaagcaagcatttccacataatcatgggcagctctgtcagaccaatacctgcgatcaatgcaggtgattgtgagtgctggaaaattctcttggacaatacagtaaagctttgactgagtggcagtattcatgaagatgagctcactgggttcaaacaccccgatcttgttgatggtcttcacataagattggctgtcacagatctgacagagtactgcttctgaagtggaaagattgacaaacgcaaggcccactgtaggtgatacacctctggattcactgacggcgcatatcacttcctgcgatgcaatgctcgtggcggttgtggttggtcttgctgtccatggccgttcactagcatggtctgcaatgcgtacggaggtggttgtctcgtcttccaatgggtaggacgttcctattgtataagctgaggacatcttgatttcacacagcggtcttattatcagataatcgaatcaaattcggcatcattcggcgtaattcattgtcttcagcaagacgcaagacaactgaagtgggaaggcaggttatggttctcgaaaaggaaggagtcgcgcgggcgataagataagatttcccgaagcggtttagggcggcgctccaaaatttctacaatccgacatacaaaatccccaacgtcgaattccttcgctacgattacttcgtctgctcaactcgcctgaaaatggcgactctcgtacctcctccgagcaagcgccaaaagcgcgaaattgcggagaaggcacgacagcaacaggaaatcgagaccatccccagcgacctgggtagcatccgagtccagtttgtcgaccaggccactggcacgccgactgggcctgcagtgtctgttcctgttgctgatgccaatgttaagaaccttgagacacttctgaatacactccagggtaatgtaggtacgcatgttttgttccggcaagatttcgtcaaatctgcccagacctgagactaatcctctgtgacacggcaggacgaacatgagcgggtgccatatagattcacatatcagtcagaaggcgaagatgggcaggttgtcgacattttgtcggatttatatcattcgttgttgaagccgggtatcaaaaccaccgaagatacagtccacctccactacaccccgcaagcagtatttcgagtcaaggcggtatcacgatgttctgcctcaatatccggccatggagaagcaatccttgctgccgcgttctcgcccgtgtcctcggctacaatggttactggaagcggtgactcaaccgctagaatttgggattgcgaaactggcacgcctttacatacactaaagggtcatacgaactgggtcctggcggtcagttattctcccaatggcgccataattgcaacagggagtatggacaatacggtgagactgtgggatgcaaagaaaggctcgcctctaggaggcccactcaagggccatactaagtggatcaacagtctggcgtgggagccttatcacctgcaagagtctggcaggcctcgtttggcctccgcgtcgaaggacacgacggtccgcgtctgggatgttgtcaacaagaggattgatattgtcctcacgggacacaagggttcagtgacctgtgttcgctggggcgggacaggaaagatatatacttcctcccatgacaagacgatcaaagtgtggagttcgaaagatggcagtctcattcagacgttggctgcgcatgcccaccgcgtaaaccacctggctctctccactgactttgtcctccgtactgcgttctacgaccacacgaagaaagttccagagacagaggcggaaagggtcgagaaggcgaagcagcgattcgagaaagctgccacaatcaataacagaattacagagaagcttgtgtcggcaagtgacgattataccatgtatctctgggatccggagagctcgtcgaagccgattgctcggttactgggtcaccagaaagaagtgaaccacgtcacgttttctcctgacatggcgtacattgcctctgcggggttcgacacccatgtcaaattatggaacgcccgcgatgggaagtaagttctgttttgcacctgatacatgccatcttcagattactgatgaggaacaggttcatcacaacactgcggggtcacgtcggcgccgtttatcagtgctgcttctcggctgattctcgtcttttggtctcatcctccaaagacacaactcttaaagtctgggatgtccgtacggggaagctggccatggatcttccagggcaccaggacgaagtctacgccgtggactggagcccagacggcgaaagagtcggcagtggaggcagagacaaagcggtgaagatatggcggcattgatctcgccaacagggtcgagatattgcgtatagattatgtcgatgataccctgaaaaagcagccgacgatttctgattatgtttctctcatgagacgtttaaaagttaaagatctgttatacactggagtggtcctagtagatagacttgggaatatacatgagttacaccgagattacaccctaaactgaatagatgagtgaaaaccgagcaacgcaacgcagttatcttggccttttttttttaaaaaaaaaatctttcccggtcctatgtctaaagtgaatctttgacgagcgttgagaagtctagtagaggtatacacatcaaccttgtgtacatatacggctgagatcatcccattcgcactgagactgtttatttagtatctctaccagatacatatggacatgtagagaattcgaagcactgatacaattcatctttcgcagcaagcacactgattaggtagtttgttccagactatctggattaccgccttgtttcctttcctgctgggagaacgcccgaagctaataataggtgctgctggatcagtgtaatcccgaattccgagagtcctcattctgaacgtatgtatgagaaacgtctggaccgaaatcgacgaagactaataatgagtttcacgtacgaaacgtcattcctccatagatcgtctgcttgccttccacatagttcgatttttcgaattgttgatgccgagacactgtgctagactgcacgatagtcagtcctactaccatcgtatacaggggcgaagctagccagccagccatctcctagctaggaaggcgaacaggattctgtttcaaaggatcccatgcgtcttgctcctgctgtgccagtgccatattagcagaagactgatataaggagccgatatgagataaaaatggggagaataaaagaatattcctgctcagcatccttcttggccccgctgatactaccgtctttgacaggttttccctttgggtctgtgctcgtgtgggctgcggcgactgtcgtggttgaagtagttgacggttcggggggagatgtagggtttgcattctttgcagccctcactgggaatttccgtgatgaatcagatcatcatgatgcagttggtctggaacgattcaaaaggtgctgaaagagcctgtgtcattcgaaatgaaagcccatgtgggggatgcacaagatgcaatcttcttgccaggctgttgtgatcacatgttgcaagagcagccttgttcaggctaactctccataaccatcagcctcccccagccttgcattgtaccaacaaggatataccacgtaagtcagcacaccattgcagggactattagtgatatcggcccagcttgatccggatgaggggtgtcaacgtggcagttctaaaaaggcctgaagacagaacaatgctgacccttaggttagttgcaagatattacctcccggctcccttttttccatttagcatatgagcgtgctgtcttatataaggaaatacaaagatgttacgacagctactcccgcggaaaagaaggacaaacggcaacgaaggggagttccacgatccaagccctactcggcgcaattcttcttacggcctcaaaaaactctacgagcccgacaatgctgttgttgagtaagtcacttcgtcagatattcaccagtgttgcatattactaatgcgaggcttgtgcccagcattatcttcatccatggtctgaccggtgatcggatgaggacctggacagcgcgaaacgccctcacgccatggccccagtcgcttctaccacaaaagctccctcaggctcgaatactcacttttggctatgacgcccgtatcgtcgactggagggctttggtctcgaagaacaggattggtgaccactctcggaacttgctggctgccatagcgacgtgccgagaggaggatgacaccataatgatctctcaatctcaaggcatagcgaaagaaaagaacattcctgaccagtctgcagaatgatcgccccatcatattcgtcgcgcatagtatgggtggccttgtgtgtgaggatgttcgctcagcaaatgaatcctccaacttgccgggatataatacctgctgactcgcccggcgataggctctcttgtcgtcgcgaggaagtcctgaaagacaccttcagcagatccttcgccgcacccacggtatcatctttctcggcacgccgcattccggttctggctttgcacagtgggccgaaggtttggccaaattgatcgggctgatcaaacagaccaattcgcagattatccaggtgcttcgggccgattctgaagtgctggaacggatccagatcgacttccattctatgctgagagcacgggtcaacgatggagcacatcccatcgccattacctgtttttacgaagagctgcctctaccgggcatggacgaggtgaaagataacaagcataccctgtgtccgcaacgcatgctgactgcttatgcactgttcagattgttccgaagcgcgctgccactcttcccgggtacacctccattggaatccacagtaaccatatggatatgactagattcgagaccgaggatgacccgggctttgtgagcatcgtaggcgagcttcggagatggattaaggagttagctccaggacccgtggctgcagaacgcatcgtcatacgcgagcaaggagtatctcggaatggcgatggtgagaacagagaccttggtcggtacaccaagattatacggtccaatctggtgtacggaggtaatcaagttgtctatggtggtatgagatttggtatgttgaaatatgtgtatttctgttcacgacagtgctgacttgacctagggtaaatgcaactgcgataatcgagtaagtgacggactaaatcgataaacatcgcaaggagatatctgggatactcaagtggcgatgtaatctccctacttgggctttagactgaccctgaagacaacatctataatatctttctgaggcaaaatccacagtttagtaaaatagacgatgtgtattgtattctggtctcagactttatgtcatggaagcagaataactgcgaccccaaagctcagtcgcggaaaatcggctcacttgaatgacgagaacgcggtgtcagcctcaaacgtcgttcttgcaaagagaaattcccccaccacagctctccacgaactttgacagcttcgtctgataatccatctttccagacagagctctctatctggcaggccacctcttcatcatcgatcctatactctgttgagtcggcgggagtccatttcgtgaacactcttcttcctccttcattctgtcgaagaaggaatagttctccacgtttgtgcatgaattgtctacaaagggccggatgcttgtaggacactatttttgacgctcgatgtttccaaaagatccgcccaaatattgtacagtgcctgtcccagccaggaggtagtatatgctcgatgtctttttctttctggggcggtttccagaaacaccgcttctcctcccccgagcgtacgtgtccacgtaaaacagtcgattattctcgtcgattctccagtcccagccttcaggcagtttttgtttttcattcagtggatgcagttccgattcaggcagcttctcccaggtgatgagtctgcgttccttgccggacttgtcacgctgagtgaatccaggcgacggagatgaacatgttgaacacccagtcgagtttgtgttttcacggttgaattcggtattgtcagaagggcgagttcgctccctggtagaggcttgtggatgatccggatgagaatacctgggtgaggagttagatgagtcgaagggctgattcgtacggtaaccccgatatcgatttgtatactgagatgaagtgtatccataatcgaacgattagtgcccgctagatgaggaattaaaatcctggtaatctcgactattttcttgaaaatgttaggcagggtttcgtgctccacacgcccttgggaatttatcccgagcaacacaagctggtccttcaactccgacctcttcctcttcaggatctggagaaggtcggacacattctcttctttccgttgtatccgctcccagttccgtttaggattcctgcccaggtccttgtgcttctctagaaccttttccaaattcgcaatcgtatcgtgacactctttcgaaaagttattccaccactcaagatgttttgggttgcgcgcaaaaagtgattgcggcgacctcgcctccgcttcaacccgggaaaggagcgttttcagcgcagccagctgcttggtaacctgggtgccaccgcaagcctttttccaacgatagtgaacgttgctaactaggttaaagaaattggtgacattgttggcaaagtcgggaatgtccgcgtctattgacaggctatcttcgacacctgtgcaacgatcagtgacttctccaaacaactgtcatacttccagcgtttcttctgtggacaacgaactctgttgaactatatcaccgtattagaagcgtcaatagggtcgtatacgactgtgacacaatgtagccagtggacctgatgccacttactgtagatgttatgctctgtgcagtagttgtcaataagatagagatgaccatcgatggcagcaagcaggaaggagctaaggaaagattcccacctaccaaatctctgaccaccatacacgatttgcccgccccgaaccatgttcgacttttcaaaatgctgaaaagacgagtccaaaggctgttatcatgatcagtggattccaaacagatgcgcttggatcaaacactgggtactattcatcactacctctcgcctatcttcatcgtccgggtcattgccgtcttttcgtttcaggttagggacagcggacacgtctttgtccgatgacttggaggcagtctttgccagcggttcagacatgataatgacaagagcaataaacgatccaagttccaaagataacacaattgatgtgtgcaagagggtgttgcgctaaaactccactgaccagtttggccacagccagatgaggggtatacaacaggcattttgttggttccttgcgccccggttatatatactggacaggtttgttgcaatgggttgttgaaatgactgtataaggctgaggctttgctgaaaggattcatctcactcagcccccctctctccctcttcccccctggtcccccctcaccaaactatgggttccacgggccaatccaaataaattctcttcccctttcaatatatctgcatgcgctgaacaaggctgctaagccgtaagctccgggctaattcgtctacagtgcaccggtttgcatgacaagaacaaatctgggtggcacaggcatgctaggaccggctgagttgtattataattcgtcaggacgattcgaaaataagctttgggtgtggcagttaagacatctacctaagtagtaataccgaaactgaagaggagatgatgtcttaataaaatacctgttaggtcgaacgaggctaggtcggagcctcattctgcaagtcggaaccctgtaagatggattattaaagaaagtatgtttttttcagtatttctttggccaaaattcttacaatgagataataagctgggtaacttttcatttcactttaaaaaaaaagtactagacttattccccaacccaagacgttggccaatatttccccgaagtgcttgacgaagtacagacacttccacttaataagtgacctgttagggtagtaaagtctagaaaaccatctagaggtgggtttcttcacaattaagaaccaacaatcgggaagaaagaataattaatctggtagaaaactatacacctagggtccctatactagcaagcgcgggcttatgcctaagtctccagtcgtgataccttgggagcagtttagctcgatcttgtatagaccattctaaaacgagcactatggttaagcaactagaaagaagccttccaagagcatagtcatgccaaatccaatctactcacttcggcattgtctaggtggcgatagtagttggtgctgtcgagtacttcgtttcgaaattcggatggtgaagtatatgatgaagacaaaaatgttgagcactgtgccgcggcttgaacagtggtagtagtggttattgcttgtgcttgctgtccgcagatgagcggcacacaaatataaagatgctggatggtaaatagagaaaaaagggaatatgagattactccccacatctaggatcatcataagatagaacggtaaaaaagtgtagataaatagatttgagccttccagaatgaatctcttgtgaaggtcatgtgtgtatacaacatggtgagatgtcatgagattaggtaggttgtcggtgatgagtaatgaataatgatggttagccgttcatgcatataaattagtagggtcatagaacggacatcatagaaacgggttccattcctggatccgacacttgcagtagttatgaaaaacagtcatctaaagaataaaaacaaagtctgagtacaacccgtaaaataatatatatatgttctcagaccccatctgatcagatcaggtacctacttactgtatcggtgccaaaaatagcagcataccatagaagagtcatcgatgaatcactggaatatttgtcaggattatcgcaatttccacactaaactgatggtgttctcacatggttggttggttgtgactttttccaggactcattctagtgtttcagtacgtgctgaggttaatcatctagtggacatgactggcgattggctaccacaggagagacctctttaattaacacatgcgtcaaactggactcacttcccttcataaattaaaatcgagccattcacctcgtatatacaggtaatgtcattccagtagggtatactatcctgtcatcactcataaactatatagtttataagacaacaaaaaaatcatgaggggtagagatctaactcggcgtcactgtcgctatgcaccggatggaaactcaccaactcgtagcaagtacgttatatatatactgtgtcatatcatcaaggcatatatatatagaaattcgaatctccaaaatgcgggcttgcgcctacatcacgctgcatccaacaccatacatggctcgctcgacatcccgtcgcacttggaaccagtcggcccgccgttcagcgaattcgtaaacctcttccgcccggaagatgccgtagaaccgatccgcatcggcaattatggtagctagctccttggcgtcggatggatccacgagatagatctgggacagctctcgaagagccttgaaatagagaagaagttcgttgttcttgaacgtctggatgaatttgaaataatggttcatatcgctgatcttgacgtcagtaatctcgacgttgaacaaaacgggtctttaggcttacctgatcagtttcagagacccttccacactaacccgctggcgcttgagatgtttgcaaatcgccgcgaagagccgtagcccaacttcctggttgaacacatcgagcgtgctcttgtctgtgctccccaccagcatctgggtatgcgacgagacaacgtcaaccaccgcaagagcagcctcgctgacaccaacatccattgtctgccgctgtggattcatcgaggcctctgggttaaagtcggtgctcaactgtttcgtggccaggaggtagtccacctcctccatgagcacatcaattcccttgttcagtccagacgccacccgttcgtccagcatctgttcgaatttcttcttcgctttgacagccgggtcaagaaagtcgttccggtccgtcaacttcgtaccgacaagttcctgttcgtagaacacgtccatcatctggaggatgagatctcccacgttaaccagctcaagaaaggtcactaagggtttgacattggactcgtcacgctcgccttgctctcgaggtcggtagttggacagatggtccaccgccttgtcaaacccttcgataacgtgacgatggcccaggatgtggagaagagacacaaatatgcctttgcattgctgcttggcagcatccccgtattcaccaccaagcttcacaaactgtgcagcacgttcaaggctggctttggcagcatggaccaaactcaaggcaacctcgatgctaaaaagcgagcggataccctccaatttcatgttcatgatggcagcttttgcagcaagctcatccgttggagcctctggcaatgaaactggggcaggtgaaacggtagagaatcgagacacactttttagagggaggggggccgcccttgggctcctcctccgctttctggccgctgggtttgctggagaacgtaggaagaatgttcactggcatcataaccactttcttgaaagaagaaaggaagtctttcttgtctgcttgtcgattgacgttggacatcagaagagattctgtcgatgcggcctgttcggagagttgtctgtcccagtcccggactgcggtgtcacaaccttgtcggaagaagtccagctcctccgctagatagaggtcgatatgaggttcgtaaatttgacgaaggacaggtatcacagcctcgtgtaagccttcattgtcactctgactaggtcgcagatctttcatgaggttaaagcattgcacaaacgttccagagaccgccttcaaatatgactcaatattcactcggtgtagttcatcaaatagtgcggtcaagaacggagataaaacatcgctgccgaccttttcgagaaacggggtaacaacgtctagactgggcggaaacgctcggttgataatcgagatctcttcattgtaagccactccaaagcgcgtgaggaatgcttgcgtatgctcgagtttcacagtccccgttgatgtatcaatacaatccatgacattaccgtagtcggatttccgggttataagatgattatgatggataaacaggtcaattgcagactgacccccattgagtatccacagcacgtgtgcatatctccgcatgagaacgtcaatatcgtccgattcatagccatttcgaaactctttgagagccgcggtctcgaacaacgagacagccatacgaagccgctgttctctctcgtaccagccttgagtattgtcactctttgcgaatgcctgcagttgagaaagcatctgagcctgactctctggctcagtgtacctcttgaaaaccaagctctccgttgagcctcctgaatttgcaatgtcctcgtagaacggcgataaagcagcatgaaccttcccatactcctggcgcgcctgcccacggattgacttgacgtttttcaataccaccagtgcactgtcttgtgtggaagttacagattgctccaaatttcccacagatgatatcggtgttggatcaaagccgtcagacgtcgaggctttccggtcatgggactggtgttctgttccattcgcgatgggcttctccccattcaatactacacctcctgtcccttgtgggagaccagtcatgatagccgcctgctctgatagttttcttgcttgcagttcgtcccagcaacccatgagcttcagtctctgcacccatcttgtatcatcgtatgccatttcccgcatccgcttcgatgtttgtgcgatcctgataagatctgttggccccacataatccaagaccagagacattatctctacgttatattagcttctttcagagcccgttgaatcaatacagcagaccgcataccggcaggaagagctggcttcgaaaactccatcgaagccatcttcagcgaagccacgacgtctcggcgcgggccgataaacaccgggggtttcttgacgttcgacatgttgcctctctcgaaaagacattgggaaggacaagcggtggaaattcttgtcgcaagaggggtgttgcggcggacgatggcctcgctgggtcgacaaagtgaccgctggtattgttggataaactatctctagaatatagaagatcgtatgactctctttacggatccggatccgtcatctttgaagtatagaaaagagcagaaaagaagcaaagtccaaggcgctagagtggtcaatggcttcaaaacaactgttgaagctgcagtcaggaagaaggcgggcatgagcggcaaaatgcccctattggctcatatcccagttaggcgttatacttgacagcctcaccatctaacgagttgctggcatgactgaactcgaattgcaagtgaaactcattagcatctgggctttggatgaatcctgctggtgtcattttacgtctggccaaagagaggcgggatctaggatatcagcgagccactaggtggatacatgtgtgacattatgagtattggacgctcccaaataataatgcgtagtgggagagacttctgtatggacatgtctttggttgcaagaggtctcgttcaactgtgggctgctcgaggcatgatatcaactgccatctcttagagagctatcctaggtcgtatgaggatgtacctggacgtctcgggctttcatgggtggcttttctgatagtcgtaattctcgaagtcaattgacatcgacgatgcttctataactgctcaatgacctcgtcgaaggcactgcaaccaggcatgccgtcctcgtggcatggacgagagggagagccggcgcggttttcgccgaggatggccaaggccggtcgtccagccaatcagcgcgaaggtgtagccaatccacccccaagagaaacttgacgagctccgacggccaacttccaacttcacttccagcctcaaggacatctaccctcgcggtgcccaccgtccctcccctctctacccctcccgcgctcgtgttccttcctcctctgtttcgttcaacggagggtcttggttacattagcagcaatgctggctcgttccgtcctgcgtgctgcgccctcgcgggccatcgcacgcagcctccgccagccctcggtacgcaatcccacggtgcggctgccattgaccctgctggaatagggcaatggcttttccagacctccttcattgactctggcggtcttttactgatcaattgtccagcgggcatcttccacgtcatccggcgctgagaatgcgagctctccgttttacctcaccctcacggcaaccgctgccacgatcgctactatcggctcggcggcctggtactaccatctgttcggacaagaggcttttgcaatgacgcctgctgaggaagggtgagctctgcggctgagtcgactcgattggggaatggtgttgaggctgatacgcgatgatccaggttgcacccgactcggtacccttgggaacaccagaaatggaacaagaccttcgatcaccaggcgtgagtagccaattactctgctagagcgcaattcatactcatccatttccagccttcgccgtggtttccaggtctaccgcgaagtttgctcaagctgccactccctcagccgtgtcccgtggcgcgcatttgttggtgtgatgcacactgttgatgaaatgaaggccatggccgaagagcacgagtacgacactgagccgaacgagcagggcgagatcgagaagcgccctggaaagctttccgactacatcccgcctccctacaagaacgaggaggccgcccgtgctgccaacaacggtgcccttcctccggatctgagcttgatcgtcaagggtcgtcacggtggctgcaactacatcttcagtcttttgacgggttacccggatgagcctccggcgggcgcccaggtccagcagggcatgaacttcaacccgtacttccccggcaccggtatgaaacatgaatcctaattaataaaatcagcgagactaacgtgtggtaggtatcgccatggctcgtgtcctgtttgacggtctggttgagtacgaggacggcaccccggccacgacctctcagatggccaaggacgttgtcgaattcctgaactgggccgccgaaccagagatggatgagcgcaagaagatgggaatgaaggcgctgaccttgctggcgggtctgttcgccctgagcgtgtgggtcaagcgatacaagtgggctgccatcaagacgaggaagatcgtgtacaacccgccggtgaaacactaaacggagaactcgtctcggtcatcgactattccccttgtcatctgtcttgtctccagccgatatcatccagaaatctctgtatctgtacgctagatattttcttgaaactgtgtttgacaaaagagaaagacggcacctctcttttaactccacaggtatacattggcgtatgccctgtactcctttgtatacatacatcaaaatagtcgttagatttcctttgtgaagtgtctgctcgtttattttttccattttttgattcctgatgtctcttttcctgtgctactgttgaatagtaaacccatgtattgatgtctgtattgatgtctgtatgatcctatacaagaaaaaaaaaaagaaggtccaacatgactatcatcatcatacatctccaatcgtcctctcaccatcaccaaagattttccggaaaaacctatcgtaactcgaccacatagccttcattacggcatcttgtactttccccagccagtcgggactacgaccatcagcatccgcgagaagcgacgaaagaactacgagtacgaagagcggaggaagccacagtgtgagaaagacgcctttccccacgcgctgccgcagggtggttatgcgatacggccggatggaggcgagataggcgcggtactcggtagggaagtccagctctgcagcgccggtcctgatcaggttgagatagcgggcggagggctgggcgtatgccggatcgggtcggaggagggaatatcgattcgtctcatcattccacgcgaatggggagagaagcgtatgcgccttgaacggaggcagcgttgtatttctgtccctatcaggatgctcgggcacagggtcttccgggcgatacgagtcgggaaacgggtagcaggtgacgacgacatcgcggtatccgtggcctgcgccttcggtcgcgatgatgcgcgcgtagtcggccagggtcacctcgtagacgaccccgataagcggtttgtgccatcggttcttgtgatagtcctgtgtgtgggcctgtccatgtctctggtcctggaggagaggggctttctcgatatcgatagaactagtaggatcaacatattcagcaacagcttcttctttttccgcgccctcttcgtctttgttagcagtattggtacggaactgcgtccccgcaaagcacggctctatatacggcacgccaggaagatcaaaggtcagtctcaattccggcacgtagacgttgacctgcgaaagcggtctgatgccgcggcgtccgcggaacgtctctaccgacaggttcgagccgtatgccaggtagagcaccgtctgctcctctttttcgggaggttgcttcttctcagttggtctgtctccgtctctgtctccgtcatggtggtgagtgtcggaggaggtgacctttcgtggaagatcctgggcaagttctagcgaatctggtcgagtcgatctctgcagtcgctctgaggatggtcgtgggagagaagagcaggccctataacaaggggtagtcttttttgtgccagcacgagtgaatgcgagtactctctcgtggaatcgagggcgttcgggcatgatcgttgacgctgatgttgatgttgatgccccaggcgacaatccctattcctccgctatgcagaaccttgggttagtagatgagattgcgcaatacgcgccatgtatgtacgtatttaagtatatatgtgcaattggatcagaatcaacctacagatcagaaaaagactcaaaaacgaaatagtgatcctcactctgatgcggagctcatgtaggcagctaccagcgtacgccatcctggacctcggcacccgccaagccgggttcgggattggcctcttccgtgtctaagcctggattggtagtagagagctaatccatggatatatacaagggatcgttatgcttaaattgatcggagactgatcagattaaaaaaaaagtcgattgtcagtcatgatggaattgctcatgacagtttctccttcaaagggagacgcttgctgacgaattgtgcctatgatgctgtttaagaaatattatatccgcagtctgctacctccgtactgcaagtgagttgagttattcatttgaagatcataggcagtcctggttggaatgaatcatggcagtggagctgtatagaggtcatctatatatatatatatggaacattggcaataaataaaaaggctcacattcctactgagtcctcttctttctcagttgaggatgctcgtgaagaattcatcttgatactgggctagaagaaacagggaagatcagtatcgctcatccttcatctacctgttctgctctaggacgcaacctcgatgtaaatatatacggcagatttaaaactgcaccatctcagcagttatccaaagcactacaggacatcttcaaacacagattgttatatttagtccatctccctttaaatgcgggtcgcatcaatttgacaatatatatagtcaagcgagacgacctaatctggcaggcagcctcaaagtgtctcttttatcttaatctagcgaaagacacataacaccgctttaaattcgttgatacactcctgccagcggacaataataacgagcccatgtggttacgtcgtgctgctacgaaaggggcaatagtaatggcatggataatatggaagttttttggcttcgaccaataatgggccggtggtagtcagcacgctctttttttcgggaaccagccggacggcccgggcagttttgtactgacaaatcgtagacggcccctgcctcggcgaataacaggcagctgattacattagggacaaagcaatatgacagaatagaagaatacgggcaaatggtggaatccaattttttttgcgctttcgaattctcgataacccttatactagatacatttctcatttccctagctgcatgcaagggcggttcaatcgacattaaacgttaggatgattcgcgttcatacagtacggagtatgtatgagtcagtgagtcacatcgggggggtaccagggagcaaatcctacctatctgggactttaattagtcctcctgctaatactgtacgaagtaagacttgtgcatacagcccggggaaggccgaagcttcaccgaagtctaaccaggaaggacaagaaaagaatgattcatggggcggagcgatgatctgaccatccccgctaggttaattcgggtagaaccctgtaatcacattaccgagaaaaatacctactgactaaaattgagcatcaattgtagtctgatctgtcatgcgatcatacagtggcagctttgcgattctttgagcacaacggctagcagttgagctctgcaccaagtgaaaggtcagcagctacacgtatttcatgcgactactagcaaatcaatgaccatatttagcaagtcaggcatagataagatattcaagaaaaaggaaatccagccctgaatattagcgatattatagcgtcctaataagcaaatgtggacttgatgcatacggagtatttgatatcttcacctatacttaccagaaatagcgagtatctgtctattgcagcgcattgaattctctctactgtgttatgagtcccaatgggagcaccctatgaaacaactacgcctttgtttactgtcttaatgacatatagaggcttgtcaggaccagaatcatgtgataggattctcaagatccaggagcttcatgggataacatgcccattaagagcaaagtctagtcactcacttactatctgtctctagaaagaagggaagaaatcgaaaactttatcttaaagagcaggggatataagcacaaagactgaactattttatacattgacaaagaaacaaaactcatgctgcattatcacttagtaggaaacacgtctaatacgccacatgcaagcagatgaaagaaaacctgcagcagggcgactcgaactgttacaccagcagaactattgtccatggatgggatctgttatctcattaagttcatggaaggccgcctccggagtacggagtattgcagctaatcaactacgatgtatttgcatcctgtcgcacaagaagaagcgtcaatcagccgaaatcggactgctcacaatatatcagtgtttgattttgtttattttcactttaaatattattcaagtcagcagaattaattaccatagtactgatctttgaacagttttatagataaaaatcttaggtactccgtactgataattcccactagtattttttgcggtaattcgatttcaaaccttacccgatcggggtagcgaggggctcaccatacgtcagcggacaaaggaaggagcgatgactcggtggccgaaatcgcaggcgtggattttttttatctaatcaccagggccgagacttgcagctttcgatgaatcataagggggggggaaattaattttgcctctttaactacttaacaattgattgttcaatccttttttttgtgtctgcgcgatttgcgattttttttccttttgttcgacgagctggttctcaccgaacttgcagagaattgaattgaattgaattgaattgagaattgctgcttgcttgcttgctggcccccaccttcctgatcatgtcggtgagttacaatttacaaccctttataagaagtgtcgcaaccagctcgtcgcgaggatgactgctatagcaatatgctgactctacaatgtagcaattcttcattgagaaccccaatgtgggcaacttcagccatcctgaagattcacggagtatgtcgcctttaattttttttctagtgaatgtctactgacaaatttgcacttcagttcgaggatacaaccccctcacgccgccaaacctgctacaacatgagattgcccagacggagaattcgttgaaaacggtgctccagggccggcaggaggccgtggccatcgtgcacggcaccgacccgctcaaccggctgctggtcatcgtcggcccctgctcgatccacgacccggacatggcgctcgagtactgcgaccgcctgctgaagctgagggagaagtacgcggacgcgctgctgatcgtcatgcgctcgtacctggagaagccgcgcacgacggtcgggtggaagggcctgatcaacgacccggatatcgacaacagcttcaagatcaacaagggcctgcgcgtcgcgcgccagctcttcgtcgatctgacggataagggcatgcccatcgccagcgagatgctcgataccatctccccgcagttcctcgccgactgtctgtccgtcggagccatcggcgcccgcacgaccgagtcccaggtccaccgggagctggcgtctggtctgtcgttccctgtgggcttcaagaacggcacggacggcagtctggatatcgcagtcgatgccattggcgccgtcaagcacccgcaccacttcctgtcggtgacgaaacccggtgtggccgccattgtcggcacggtcggcaacgaggactgcttcgtgatcctgcgcggcggcaagaagggcaccaactacgacgcaaagagcatcgctgaggccaaggccaagctggtcgagaagggcctcaagccgcggctgatggtcgactgcagccacggcaactcgcagaagaaccacaagaaccagcccaaggtggcggcggtgttggcagagcagatcgccgcgggagagacgggcatcatgggagtgatgatcgagagcaacatcaatgagggtgtgtacatacatacagaaataatgtcctttttgctttagtctagtttagacgaggctaacagcgtctgcgcaggcaaccagaaggtcccacccgagggcaaggccggcctgaagtacggcgtcagcatcaccgacgcctgcatcggatgggaagacaccgagatcgttctggagcagctggccgaggccgtccgcacgcggcagaagaagctcgccgtcaacggaacggcgcattaattcagcacagcacaactcaactcaactgaaccatcaggacgagaccggacgagactagacgagccacgaacgagcgagggaacgagaacaggaacgggattaatactagctttgttagtggactgattgggaaagaaaaaaaaagagagagagaacaaaaaaaattttcggattccccatttcattacgtatctttttttttgtcttttattatctccttgaaagattccctcgatcttcattattttatttcatttgtttttggtcctcatctattatttcccaagagagaaggagaaaaagacgaagaaaaaaaagtttctgttcgagtcgagtcgagtcgcatgcgcttttttttttcttctttttgcacatgagatatagtctatctatctatctatctgattgagacctatctaattaggaacctgatctgatcacgagaggattggatgagattagattatgtcatgatcaaaaagcaaaagcaaaagagaaaaaaaaaccaagtgcggaaagttcatggacttgttgttttctttttatggaggcttcgtatttggattattcaatcagtcaattgaatttaattcagttcagttcagctcaattcagccttcgatagaccaaacagacgaactacctctcatcagagtaagtagtaagtagtagtcatctcgaaaggttaagatcaactaaagattcaaggaagaaagatgaatgagaagggcgatattttcaggtatcattccaagtatataatataataatacaatatacacacttatatcgaagggaatcaatcgatcaatcaatcaaccaaccaaccatcaacccatccgggatctctgcgtcgatccatgagatagataccatgacatagcatgttgctataaccgctatcgatcaatcaatcaatcatatcaagaaaaaaatatgaatatgaatatggataaatctctcatcataagtggcgtttgcatcgtatcatggaaatgcctttgaaatgcctttgtccttgcctgctcgcttgattccatgctccctgtaatcccaaccggctgaacgcaaatgcttgaaagacatgacaacggtgaatatgaagcagatatatgatggtaacatatctcgtataaaatgtgatatcgtgatgcaaaaattcaagcttggctgcctactgccactggctgatcggcaaccctcgctctcgctccgacggatgtcgcaaccccgacgtcgtcgacgtcgcccacaacgctttccgcaggtcgtgagggtcgtaggatgcaatgtcgtggaactcgagtcctgcggcagtgctgttatcaccgccagtcccaggctccatccacaggccctcacgggcccccagttcggggatcttgagatccataatgcatgcagcaaaggaaggacggcgcttcttgcggttgttggtgttgtcggtgtcgtcagatgttcttgatggagaggaaggcgaggacgttccattttcactgctgccacttgtcgacatggcgaacagcttccggtcaaaggacgccggctggctgagctgtttccgcttgcgcgtggccctgaccggcagcggcgagagaagaccagactcggctcggtcgaccaacatcgccgacgcaatgctgccatcggatccgatcgaaagcgacttgacgccaatgttgcccacaggccgagtccgcgacgtgcacgtgtcgatgtcgaagatgcgcgcctccccggaggcaccaaacgcccacacacgcaccccgccatgcgacgtctgaatcgagaattcgaccaccctctccatcttcccgatctccttcccgtagatcttcagcggccacatcatcgccgtcggtcggtagctgacccggagcaggaactcccagtctccattctggttctgcgccaggctgccacgacgctgctgagtgccgcggtccgcgtccaagaaccagtcacgggccagatcgctgtctcccatgaccccgtccccctgcagctcatgctcccgtcggatgacattgaagacatccagcggcaccgaatacagaatgatccggtcctggtaggcggccacgatccggagaccccagctcagatctgatccagcggcaaacacggtagggacgcgttcctctttccaaccgtcagtgaggttgctgtcaaaaggcggaacgcaaacgagcgctctggtcaggctggtgggaccgccgattggagcgtcagacccaatacagaggagcccggtaaagggttcgatgaaaaggatatgcaagccgtcgttgatcggcatcgcacggtagtggtggcagtgtgtcgccctcacgaggctcaaccgtccattctttcgtggcgtccaatgcgtgaaggagctgacgccggttgacagatggaattggcacgccaccccgtcttctccgttcgcggatcgatagcactggcatccagatgcacctggccccgccagggatgagatcagtctcaacttggtggtttcgtcaatctccgagcgctgaggcaggaaatgcaggatctcggccggctgggacatcgggaagagcttccgctggtcttctttggtcttctcgtcgacccagtggagctcaattcctgaaccacacccaaaggcgacgcatcgacggcccggacagatcgaaacgctgcgcggcgggtcttctgccgaacacaggtcgtggtagtactttcgaggagtcctggtcactcggttcatcgtccgccgtgacgatacgggacgagaagacaagcctggtctgccaccaccgcgaggaccagcctcagcgacggtggcactggaagcgattgcttcacgtatctcattgagggtcgtatcgtctttcacgtctgcctgtcccacgctaccagagcttctcttcgagacgggagaggacggttccccagacggatagacaggcgcccctttgatgtcgcatatcatgccgacacgaccccggagcaatgctgcaatgacaaatcgcggcgtgctggtgtcaatggtagccgagagaacctcgtaagggcacccgatgctggagatgggcaagatatcgagatcatcatcatgaagagtctccggcgtcttgtccgctgataaaggaggaggctgggagtctcctcgttttctgtttcggaggtggtagacatagatcatgcagcccgtcgcaaccagcacgtaatggccacaactgctgacactaaatttcagcgaacgtgagaaagccgggtctctcagggccgccgtgagccggggagtgtgggacggtccgcttaatacgctacgggcatacccaggcgactctttcggcagggattcacgcgacaacttggagaaatccaccactgcagtaggcagaaaaccgcctcgttccacattattcttgcgaccagacaagagacattcggtcgagaaacgcttgctcattctccacacaagactctcctcgacctcgttagccggacgagctaactggcagtcccgctgccaggcatcccaccagccggctctcttcaacatggcctccaacagatctttattcaagctggcgcgcatccactgggagcacgtccgtcgagcattgtcaaagtctcgcggactcagcatgctaaagatttgaaacagaatctcgggcggggtgacattggccgccgggggagtcagcggcgccacctgatcgactgctcgacgccatgccttgcacgttagacggagagcgagatgagacgatctgggaagaagccgtagcagtcttttggccactgcacgtgggatacttggtgcaggcctcgattgcgacggagttctctcaactgagccaagagcatcctccgacgaaggtagctccttgctatcatccagcgacattggcgaaacgggttccattggtggcgattctcccgccgaatgaatcgggctggatacccctgacaccgaggacccattttccgagctggcggtttcctccgaggcaggtgaggaagccaaatactcgctggcgatatctgacttgtgtgtttctgtcgcctggcccagtggcgaatctaaggtgataatatctggtgtctcgtccatcgcttgtgtatctgccgcaaagcctgagaaatctgactgcgtcccttcccaggtgctcgaccaatgaagacacttttcaggcatagagcctggattgctctgacatgtggattgcgattgttctgtccagaatggccgcgttggccccgtccacggttcgtcgcacatgatgggcaccgatgccggtgacgaattgaccactggttgttctccgagcaagaaagtcgtcgtaatggagcagaaggaatattctgagatatctttcgccagcgcaggaataagagcaatctaatcctgcgcggcgccaaggtgaacaatatcttatgcgggcatcgaaaaagggggtaccttgcgaggtagcttcttcagagctagatcgcggataggcgccaatcgttaattagaccgcttgcgatggaagctcgataactgtcagactgggagctattgcaagccacggcgttccagactcggtaatgtggaaagtaaaccgagtcggtgtgaccaatgtatcggactaatcatatcagaggcgccaatttagccaggaagccacgacgatgagggatggacgttgcgtagctacttccgagctctcattcgcatccccgagttttgtagactcaggtcaatgggggttgcaagctggcatcgcgccgtgtgggccaattcagcaaaatattcaggtcacgcggaaggatagagatgggctggcggaagcttccgtcataggtaaatggggccaagttgcccttggatatatactgtactgtccacagcgacaaaaaaaaaagcagctatatagttcacagaaggggaatgagaaaagagttcatgagacccaggggtgagaaaaaaaaattcacccaggattcagacttccagaatgcagcacgattcttgtgcggaccagggcagcttatgagaggagcgacagcttttcacgcgcctggagccgtggtccactgtccggctgacgtcgataagggctccgctggcgtctcaggagccgccgagcagcagtggagcccgatgggatccatggggcgccccattgctccgtattcacggcgatttggcgcgagcaacggggtggagtagttagataatggcggtggcccggatccacggggcggggggaaggacagccagtgccgggcgcccgcgtgggagagacggatccgccacagcggaggagcgcgaggctagaaaacgggctggacgagtgaacaaaggagagaggaatgaaatccggagtctggagcaagagacgagcattagttagccacagcccgctgagtttttctgcaaggatgccaggacgttactgaggttgtgctggacgatcagtgcgtccgttatcaccgctaactccagctgcagccaaaccgtcgataacatcggaataatagatagatagggataagagcagtgggatgagacgacgcacgggggaaggcgagtgtcgacatcatgaaacagagtcttggtctggctggcgcgtggtgctgtaaaggcatccgaggaatgcggcggacgggcctgatgccgaatgcagccagcctttttgccccttgtctgtgcgatcgctcgcctgggctattctgggggaaatccaagtcaaccgcgtcgtaagggatgccacatccatcgttggtcgttgctgctcgagacacaaagtcgtgtttgtttgtttggtcgagtgttgtgggagtataccagcacgccacgtcatgtcgctaacaaaagaagttctttccccggatggagcacccgctgcctgcactccgtcactgccagaatgagcagccgatcgatgtcgatgtcttttcagaactgcaagaagaccgttctccagtacggagattattgctgaagccattgacttctccgatccacgccacagacctcccagcctcctcgcccctcgaaatcttagatcattgcctattttggccatcccgacctccatgcatcctgcatctgcactgcgttgcatgtatcacccgccagacaggggtgtcctgcagggcgccttcgttgggctgagagaactgcagaaaaaatcccaatccagtcctttcaccgaagtatatttctgatctactacaatgtaaaacaggatccggccgcggcccaactcatacctccaaattctttatctgcatcagatgtgcgactggcatgcgcaccagcccccaaaactgaccttttctagatcgactctgtccccccaaaagtgagacagaagccacgaccctcacgtcaccttctgcagagtttatttctgtggaatgtggagggcaggttaaggtccgagcactcgacaacacagcacatacttggttaggaagcaagcctttttcttctacagaagtgtagaacacatccgaaagcggtaacaaaaaataaataaaaataaataaaaataaacaaaaaataaacaaaaagcaaggatacgtctctgttctcagggctgtggcggagattaactgacggaagaagaaagggaggaattcgactaacgttgcaagtaatttggagactgccctaaaaaatacagaaaaagaagctgacgaatagaaggagagaaggctaggggatagcaagagatattttaatatcctttgctagctggcatggccatatggccagtctatcatctacgtgccttttacaaacctgagtatttttgtctacgtaaatcttctttctttttgaccaggaccacgcttttcactttttactgtccttatatcttatcatctgatctgtttagaaataagtgaacactatatgccaggaatacctttaatttttatttctgaagagctggttggtttgaacttctattgctcggtgggtatggagtaggtatgcatttacatgtccatagactcatatactatctcgagctcacagcatatcgacggtggacaattgtcttgcttgttcttcctttaacagactactcctctttttttttttttaaataaagtccccacaatgatatgatggtgttcacggatgcggtgcttggcatatgaatgtatatttacttaatgctcatttatataattgaaaaactaatcagtagaaaaagaaagacaggaatgattgacaggaatgattgtccaagaagctgatgaatgaaataaaaattgcatatgaagtggtacagacgtctatgtgacccctcgattgaaaatcctcactttcgagtctgcacttcacaggattgacttcagacttcatcttgcctagcatgtcgatgccaccgaaaccaccgacgacttcgtgctcttcccgtcctcctctgcagtcacctgcacataactagtggcattaatgacggcgacggtctcgaaccccgtcttgttgaccaccgcggcgagcctcaactgagttggactcgtcccgccatagacatgccattggcggtgctctgtcgcgccgttccagctcatatacacctttgtccggttgttttcagcacaggcaaacgccacgggcggtgtcttgggccgtccggtccatacggagcgaaacccccggtagctggccacttggttatcctcgccgaactgaaccgtcatgacgcactgtccgatggaattgtactccttgatcttggggatctggtcgtgagccaggaccacgtgtccgcctggcaggacttgatagttgccctgtgactcgctgtatatggtgtcgttgggatccaacagcgttcggtctgcagtggcctctcgtgacttcagatccagggtcagcaccagcccggtggttgggtgggtgccgttgtcgatcggggagttggcgttgttgtggatactgaacgtcacctggtcaggcgaggaggagcggattcgcgcgtcatgctggtagcagaagttcgtttccggtcccagacggaagtcacctccatccctcccctagattcaaaatgaggctttgctcaaagaaataggtaggggtacaagacgacttacctgaagacgccagtcgaccgtcccgttcgggttgatccggaagatggagcagtagtaccgcgacgagatcagatacgcgccgtcatcaaacaggtccaccgagttgatgtgaaagtaaccccagggatatgtcttattggcaccaaacccatccaacggcaagagggagtcttggaggggaatctcgtcgacatgctccagcgcgctccaccgatacaccacctcgttggttttgacgtcgatctcgtagaacagggaatcggccacccagctattttgcggaccccctacgggccgcagatcgtagttggtaatgttgattgctgtcaccaggatgattccccggtccgtaagacggttctcatggtatcaatgtaggaaggctttgtctcgttgtccaggggtacgaaggtcttgtctggcagaggaacgcggtagatttcctcgtaggacgcgtccagaatgctgattgacccgtatccaaagccctatgggtctttatagccagcggtgccattccagtatgtaagaacgggttcgccatccaggctctggggccggaagctgctgacaaccccagggggcccttgccagacgagctgattctcatctgtcatgattagaggcgcaaagtcgattgccccttgccagctctgatcaaagaacagcagacctggtgcagtcgtgccatctttggtgatgtgcaggtttggcggctgataagggacagtccgaaaggtctgagagggccagacggacccagcaaccaggagacgagacaaattagccatattgattccaattgctgcaacatcaacctgttggcatcggttttaaaatccgcccagatctgcttttttccgacatcgctgtgatgaagagcgatcttcactccgttggactcctttaggacaaaaccagagttcgctccaagcctaaaacaaaatagagtaaaaaaaggagaaaagaacgcaaatcagtgatggcactccaatgtgttgggtcttcggaccagtcagcgcgagcatctaatctgatcagattagattagatataatgatttagcgtatgcaaaatttggtgcagtcttggcaccccaaaacctcaaaaaattgcaacttttgtatcggaagccctccaaaccaccaaaatactgatttttctcaccaaatcccatcgattttttactgaatttgtcatatctgaggttcttctgactttctaattaggaaattatagcctatgtctgtgccgatatcgagattacccccgtatcgcagaaaaaatggcatccgaggcgaccaactctccagaatcctctgcaccccaacctccagcaaacgaagcaatccccggagcttatagataccctcctgagcgtcctcgtcgccgtctaacgcgtggtttgagtcctgtaaagcgtgctcagatattgcgatatctccttcttggatggagacccgataacatcgccagcgagtgtctcccagcgtgttggaagagcttcgttttaacacaacctgctcatcagaatacataaaacgaaattgtgacggacccaaatccaatagtagaagccttcgtattactagggagcggtcataaatacaagagactaggctagggaggagaaagaggagcaaggaaccgggttgcctcgataattctcttgtgggatcgaatttcctgcgccacttctagcaggcgattgagtcgaattcaggctcaaagcacagaaagtatagatgaagatgcctcgacatctttccacgtttcggctacggaattatgactctctcaatccttgtccaaaattgcaggtgcaaacagaacagttgccttcttgtgtctgtcctataaacgcaattgtttaaacgccgccgcacctgctaagtgttatgaatcattcaggaccaacactgccaacttgatttgcgacaagtaagtttcatccccctgataatgcgtagtttctattggcaaggaaatcgcctttacatgtcagctttgctgctgtggaatcctcacctttacaaggatcacttggacaaccgacctatcatgattcagccaacacgtcaggagaaataactcattaccttgatcttgtagatgtactttgccatctcgtgtcatggagaactgcagtaagacttgacctagttaattggttgagtaagcgtaactactctgtacagtgcctgacaaaaagtttgcatgaggtccatgcactggcgaagccattatgccccaattagcaatagtgttaatgttgcatggatggaaaggaactagtccatagtacatacaagggggcccaatctggagctagccgaagagcatcccagcaacttattgccaagccgaaatcacgcccgggcggacagcaaaggccgagagatcagtggggttggcttacgttagtacaggcttggttgcatgacactagaataaaaagaggtaatgaccctttcgtgcacgaagaaaaaattactccttttggactagctatgttacaaacacaggggtagagagatcggactcagcatgcttcggcttcagctcatagatgcatgaattgcctacattatggacgcagattaggctttgcagttaatagttctgagatgctgcttttaattgagcatgtatgtactgttcttgacaattaaaattcctaggctaactctcatagcatatcatacttcaccggaccattggtcacattatcactacctctcgaatacctcagtggctaagccatcactgggctggaacaatgatgattagcttcacacctctgacattgttaattttcagtgctagagtgggaaagattgggagaagctgtaccaactaacaaaaacataactttgtaagttaccagtctacatttactttcagttctaacagcttgaagaaaaatctgggtcaagtccatcagatcagcagacaattgacaacattaaaaatgccaaatacagtggctattcctagtaggtgctcctgaagtggaggaaggatggattacccccttcaagtgtgaagactgggcaaggcaacatcgaacaactaaaatgagagggtacttcaagcctcgtaattttttcattcgcctcattttggatagcatatcagaatttgcagtagcttcggatgtctacgtcaggatcatatgcatgacctcgcatagtgtatatacatcgatgcgaagcatccattaactgtagaagttcgtcctaacgcgatggagttcctaagatatgatatcggtgaactgcgatggatttccgccggcagagttataagtagggtgggccacatgggacctctattccaggtctcgaacacaaactcctcggtttactgcttacatctttcaggctcgcgcacattgtttcgtactgaggaacaaccaaggggcttgccattgtaactctttttggacaaggttgagatggagaaagtcgaggtatgtggatgtctggcggggagccgccgatgtcaacagttcggaacgaagaataatctattgagggtattattacatccaacccgtcacctagacgaagaactggaggtatttcgtctgttgggatggaggagattgtcaattttggtacatttcttgctcaactttgtgtctcttatcaaaccaggctgcatgggtacagatggaactaccggctgtattgtggtctgcgagcccagagacatcctattacttaggataagcagtatataagcatgaggctgccttgatgtctccaaggttgtgttctgctcacttcactatcttctcttgtctcctctgtcttcattggctagtccgtgattacatcagccatcaacatggaccttacctcaaccgtgggttcaagcggctcgaatgccagcacctacggaatggacgttctgggatacgacgttgtcgactgcgacggccggcccccggaggagttgatcaatgctgtgatatctgctggaaaagcaatttatgacttggctccttctgatcaggttttctccatatccatcggtggaaacatcgagtgtgataaatttctcagccatggggtaaatgtaagtttcgcaccacattactgtgaatagacttaactaattctttagatggtcgatatagttcaaaaaggcacccgagtcgcatacaaatacaaggtccaacaagggccgcgaattgttcgcctcgtccggtcgcagctcgggcgggtacatccgaagtcggaccgggcggtgtcggttttcaaagtcttgaaacggactccggggcagggcaaggtcaaattcaagatttacccatatggcctgtcgaagagtgaaattcagccaaataccaggccggcagccacggttgatctagaggaacatcagttgctctgtgttcttgggggagtctgcgttgaaattgtgtcttctggagatgagacgctagtgtgggatggcttttcagcgctgcctatgggcgaagatgttttattggatgatacgctggatttcacgacccctgaccggtggaatagggtatgaacgtgtcgcacatcgttcgctatatagtatattcctcttaccaatatccacagcgagtcctggtgagcatggtgggaataaacatgttaggtctagtcattggattgccgatgtatctttctggatttcccgggtaacaagacggctgtaaaaacgctgataaatggaaaggaaatcggacagccattgagcgatctcaaaaaggtcgggataggcgccagctagcaagagtttgaccagtctctctatctcatcagaataaagatgttcaaacatgtaccaagccgtcatcaacaccgctgagatccccgggataccagtattccgctcaatatccaagaacttctgaccgaccttcaaagcccttttagtctggctttctggaagtcccctctcttcaatgaatttctcggtcgagccatgtcttcgccttttggcgggaatttgctcataacttgatgacgtattcgcataatcgagcgtcaagtgtctgacgcaaagtagacggagtagcagaacggccatgccgccttgcaaattcaaggagaggcttgcagttctcacgtcctcgccagaaccgtattgcaaggcaagtattgctccactatggtctcgaccaaaaaactcctgcaagagctccagctctttcctcgctttgttgagagtgtcttccgcagtgtgaccttgcttcggtcttggtgggatgacgaccgctcgtgttatttgttgatcacggcggcccatttcgtcttcgaattcttcgacttgttcatcgtgcaatcggattgtcttccgcccagccgagtgagggtccatggtgagaagtggctttcaatagaggaccctggtaccaaacatcccttgagttggttgagaggacgatgagaggacagcaaggcacggtgtcgtggtataaagtttgttagcacttccctgtgtattttggcgatatcgccagaaacttgccaagcctcggttcccggcggaccagtcccagtgacagtactttaacctcaccaaccaccggccgtagatggacctgtaggaaaaccatgcataatacgcttactgttgggttcgagcaacggtgggagttcgatttagtttagtcggctattgccacggcatgtcattctactgaacgacgcttccaaattacaatcaatcttggctcagctgcagcacctttgtttcatcgcaaacttacatattaaccagcagcgagttcaaaacatcgccaacagagaaaggaatcaagttcttatctcccgctattgctatgatccttgatctacttatggccatgtatgatcatttcctacctggaaaggccacatcctcagttatatgggacaatctcccacttctcattagttctgacgagaacggaaacaaagaagcactgataataggtccagctcaaagatgtcctatagttttgcttccaggaacgctggaaatggcgggattgcaggcggctgaacagatcactacatttcatagtagatccgacgtttcgaatgttttaatatcgaagacttttagactatcgagctaagaacaggaacaacttcgtcgacaagcggaaccacccccgcggttaatgccaattaggcggtatgctttggactgggctttctcccataaacaacgtacctagggattgtcagctgcaagactcaacgaatagtagcaagagggcttacagcttcgtgtaggcatgtatggacggatctccgagctgcgctttcacaagcgcaaaatggatccgggcagggttaggagaccagcctaggacttgtgtgtataggcggagaccataagcttcaacggcttcttgagtcgaaacaaaaacccattttccgagctccttcaatttctgatcctttggccatggccccagtggtaccagatataccttttcagtgacatcttcaaaccccgctttctcaatcaaatttttcaactcaggagcaatgtacatcagcgggaatccctgcagcggcgttgacaaacacctcctcagaaggctgcggggcgtttggcgaccatgaagtctctgccatgttccaaatcaaggagaatgagtatgttgcaagatagggctgacagtataagatgaactgcttagagatgagtattaatgatgcagggaacaaattccagttgggagataacacatatttaacccttcaattttcgaccacctccaaacttactccggtgtggctagtttacaagtatgagtccgtgcgatgagaatgcagtttccaggtcatgccattaaccagccgttaatatcattgccaacgcattgaagcgataactagcacgggcgaatttcctttctggattactggcaggtggggctggtatgatggagggcccagcctgggtgagacaggatctctgatagggccgtttggattatcaatggtgatcggaaaaaccctgacaccacgtcgggcaggtcttcgtggtccatcgtcggcagggtaataggttcaagcaccgtgggcagcccgtactggatgtacaggtagcgctccgtcatgaacagcaggaaatacagcttgcgcatgatcttctgatcccttaccgaatgctggaagtatgcctcctccgtgtgcatgcccagcagctgcgcaaaggagatggcctcgcggatgtagaaggcggccgtctgcgcgcgcgagggctgcttggcgtagtagaagtgcaggaagtacgacgtcaagaccgtgttaagggagacgggctccatgtaatcgaatgtcgtccgcacgcgtcgcgcctcctgggcgaacgagtgcgcggtcatgggctcgggcagcgagtcgtgcgtgacggtctggttgagatgggagagcgtcgcgccgcacagggccggtggttagcgcgtacgtctcgacatcgcggggatcgttctgcagctgctggagcagctcctatcggccagatcccgtacagtttttccttgtagagggcgaggacgatgcgcaggacggtgagagagatgcgtcgggtggacgggggtgcgggcggcgaggccagcggggcttcttctggccaggtcgttgggctgctgaagctgttcgacggcagacatctgctccttccagatcttctgcatggaggactggcgcagactgcgaggcccgctcttgcggcgctggcgcagataggtgtccgaggccgttggcgatgcagcggtggcacctgcacgccattgcagcggactttgcggatgttgcagcagtcgcaggcacgtttgggagacattgtgctgttagtctggaaaggacagcctcagatggatctgatcaatgtcaatgtcagtgtccatgtcatcttggacaatggttgtatccatgccgacgacgaggctgaggtcagtccggggttactccgcatttgcttattctcctccggcgctaattgcgccgaaagcaggacttggctatgtaatattttttaattatatttaattttgtctctcatttgccatctatggtcagacctataactcgcacataccggaagaaggttcctggcttgatacttgaaactccctaagatggaaggagaaaagagaaagacagagaaaagaaaagaggcagcgccgacggcttgccgtgcgatcccggtccctccatcttgccctccacccattcgatcgtcgacagatcgacgccgtactcgtgctgcagcacgccgcggatccagacggccgccgtcatgggtgtacagctgcacgccgatgcgcttgccattgaggtctttcggttccttgatcttgttgctgttggcgcagataaagctgtgtcggaacgcgcgcgacgcaaagacggggatggcgacaaaggaccgatcacccgcgacgtggcgggtgatatattccgaggctgacagctcgcaggcatcaaactcgcggttggcgatcatgcggtcgaagatgctggacgtcgatgaagttgacattgagtccggagggctggacctcgcccacggcgaggggcaccatgcggtcgtagagggcggaggcgaaattgcaggtgatgggcgccatggcaatcgttcagttcatggagttaggttcctaggtccggagtacatggttagggttgtcaagggcttttctacatgatgagtccacagaccaaacctctggtgtcgaatttgctgtggcaatctgaggccgaaatgccattatttgcatagttgttcatattgatattgataggtattattctttccaattgaatgcaccttccaggtttagtagtagtaggtggtgggaagcttaagtcactccgcaaaaaatcagatattaccccgcatcattttcccgcaaaagttgagctttttatcgtttatattctcctactatactttttttttctttactaaagagcatatagagatctcgatgggtagatggatcaaaataactaaaattaaaaatttccacgatccatgaattggctgagttgttacctaggtagtcttattgtattctttttaaaaaaaagaatacaataaaatattcttctatctaattgaattcatatacaagaacctagaattatataatatacgagaatattttcaattttaatcttctaccacaaaaaatttggccgatacctcgtattcataatataccaaatggttcttcaaatgcagtgtgattggccaggtccagtgggtgggcgccttgggccaggctacaatttatctgattggtcacaggacagcgtccaacatctatcttgcagagttaatgaagttgatgaaatgaaaggcaaaaatagaaacccgggcacccaattcgtcttatcattgagactttcagctttcagctccttttcccttgtttgttatatctggaaaaatttatttgtcttcagacgacggatgatctgcatgcttctaacgatgcgtaggcggagtgcttagccacagcgtgtgtgacatcgtcctgcttttgctattgcaattaattgtcgctgggctgagggtacctctatataacagccaccagcttccttgctcggggccggttcccctgcgagtgattctcgtttgaatgttctggttcattatgcctcctcgatcacccctcgaactgcccgagatcgttgcgcgtgtgctgcaacatctcgacaataagagcttggttgccgccacgcaagtcaacagcctctgggccgaggaggctacaaatgtacgtcgtcgtttaaactctgttataataattatatctaacctcgctgaatcgcgtgatagtggatctggcgaggctcgtaccgcgattccctgtattctcattcattgccgctgcgaagaatagccaactctccgaaggagcgacgagattggtaatggcaggctgactttttatttctttctttctttcttttttgcaagctgactggcgcttcaaggtatacgagaaagatccggcatttgaaactgaggacgtgtgatgatgatgatgatgatggtgacgatggtgacgattttcccatccagcgactgctgaaggaaaaggggtttcactttcccaacctggtgtccgtggtcgtcgacatcggcaatgaaaatatgaccgaggaggatatggcgcggttcttgcagctgaatctgctttgtctggagctgtttgccggatcttatactcgatggtttctggaacaaattcaggtgagtgggaggattacctgtagggtgatgatactgaacgggaattacagaaacatgcgccttcgttgcgcgcgtgcctgctcgacaatctcctggccctggaagacccagataccccccatgtgaccaaagaggatttcctcaacttcctccaggcgatgccgtccctcaagcatctggagttggtcatggggttcgagccctgtttgaccgaagacgtgatggtctatctcctgttgcgccccggactggagaaactggccatcggagctgaaactgtcttgactggcagcgtcgtgcacaaatcattcgaccagaccaacatccccgacgaggccattttcccccatctgcgctctctggaaattaccgccgaagatcgcgcggtgcggcgaatcatgcccttgctgaagaatctgcagattttaaccctctcgattctggactgcgaatctccaacggagactgtacggtgcatcgcgtcgtgcacgcgactcgagggaatcaccttgtcgtgggcggatggggaacccgtgaccggagcatcgctggagcaccttgcgtctcactgtccgatgctccgccgcgtggagttggagcccgaagccgatgccaccgtcgatctctccgacgaatggttcgaggcgattgcgtcgaaactcgtgcacctcgaggttctgtcctttcgagtgatccgcggtgcgatcagtgcccgatcgctggcctcgctcgcccgccactgtccccgtctccggcaggtcgagatgccgcccgagctggagatcctcgagctggacgacgagccggactcggtgcgcttcccgtcgctggagaccctctgcctgggacccatcgcccccggcgtgcgtcgattggaatcgcccgaagaggtcgaacgcgtccatgagcgcatcatcgccctcctggattggcggttcccggcgttgacgacgttctccttcacgcccgtgacccctcaaggccagcgagcggatccgttgcctcgcaaagtccatcggcatctgagtcaaagagggttgtggttgtcgtggtcgccgacgttggagaacgagttgacggcgaggctgatcgagccggtgagggggagcaggttcaatcctttgtcttgagatgccaatacgaaggactgtacagtacgttaatagaaggggaatgcctatataattcctagactgagaagaaggttgttaaaaacgcgttgttccttttttcaggtggctaatggtacgaagggagaaacatgagaaatactccgctatactgtacatgctatatatacatacaaacatacgacataaatccatcatcgtaacaaaatgcactgaaccagttgaaatgtacatacatatatacccacgaatgtaccaccagtccaactatactggactcgtctgttccgacaccaccacctccgtcgtccgaataatgccccgatgagtcgtttccagcccgaggattccatcctcgctggaggtccctcgatcgcctccctcaccgtcatcggaccccgtcttgctggtatcgacggcccacacgccgccggtcacggtagtcgtccactgcatcttataatcaatatccaggtagcggctgcgcctgggcgagctgggtccgtaggcctccgcatacttgtgtctctgtccgtggatcgcgtacgagttgccgccgcgccccgtggacgctttgttgttgctgcgactacttcccacgccgagcaccgcgcggaagacggtgtacagaaccggaatacacgccgcaataatcgtaacattttgctcgaggaaggaccacatcgccagatcgacggttgagaagaggatgtcttttcgggtcgtgagttcttgtaggacgacgcaccggacgatgccgaatgcggcggctctagtagacattcaacaaaatcagttatgacgatcgatgaggatggaatgtctgtcagacgtacatcagacctaggctgaggacaaagcccaaggcacatttcgtccggcgatttattttcagaccccagaggaaggtcaacggaaagaccgcaaatacgacgtcggcaaagcagaagaatgctagcaggttcgattagcaatacagccactacattggcgaggaagaaaaacgaagggacagaccagcctgggctagcgcaacatcgccattaatactcggctccaaacaccgccccctcgccgcccgcaccgcaggatcccacagcgccgccacaggccgacactgcgcgagaagcgtgatcgagctagcgacggcaaagacgaagaggacaaccgccatcccgtagagaaacaaccccgtgcgccggtcccggttgacgtgcagcaggaagaaacacacggacatcttggccgtggcgctgctgagtaagttcggcgggatggcgaccatgttgaattttgtcgcggagacgatctggtcggcggagaggtagtgttcgtgacggccgaagccgtattgcacggcgacggtttcgagggcgatgcctgttgttgcgaggacctacaaagaattaattagtcgactgaggagaatgtttgggaggagaatgtttgcctgggtgtacggaccatcgacgcgacaatccagtagtcgtccagaccgtggtacttgatgatgcgaatccgcacgtacagacgagcggcgaagacgatcagggcgatggaggtggttagccacagcgcgacgagcagcgctggggcgcggttgacgtctccgtcgggtggagcgtccattgacgacattattgcgggcaactggtcgagactggatgaagttgatcgcaacgactgtgtgcgttcagatgtgcagacaagggtgggcacgataggttacaagaaattgaataaaccgattcaatatcagtaatagctagtcgatctttgcagaagcttgcaggatcgatcatcgatgtgcgatcgatcgatcgcaagggtccaacatggatgtactgtaatattataataaaagatggacgacccttgcaaggaagctgaaaagctggaaactgtttatcgatagtatgaaggaggaggggaacgagaaaaagaatctgtctgtctgtctgtctatccctccccatcacaggaccttaatggcgatcattattatgttgcacagagtacggacagccctgtaggatgtacctgctttacgaagtaatgtatgtacagtacatacatatctaccgacatacatccgccgcaggaagatctgcaaaaagcaccggcaaccatttcagaatcttatgccggtagcccacctactttgcagaacagctattgacttgatttgtggtggcctggatccaacatttttactcagtcttgtttgggaggaggggtgtcgttattattggctgtcatggattattatcggacacgtcagagggtgcatgcagcatgcagtgagaggctgacggatggttactgtaggtaggagggtggcacacacacaaccctacatgatgttcggagctaagtagtcaccgcagtgtgtgcggggaggggaattagtcgatgacaggattcctagcggttaactgggcaagatcttttggtagtagcggttattaggttagtaaaaattgatattgaatgattcaattactacagagaggatgctttgtagattatggacatgtatatagatacgtagtgacgatagacacactgcatgtaattagttctacagagaatatggaagtcctgaattttaccccacatgcgttcaactcattcagctaactataaactcttatggagtcaattcacttcagcgattgcattgattctcagctaacattctgaactatcatagataacactgagatagataacttccacgggcccagcccgccgactcggaaaaccgtttcgcaaaacaaaaatcacgacaaaagaaattgcaagcgaacggattgctggatcgacattggccaagttggtaaaatatcaatttatatcttttctcctgccagcattgcctcgagttggcggtcacttttgattcatcattttcagcatcatttctttcatttcggatatatcacttcctcgtctcaattcctgattctcggatgtcttcaattcagcattatcgcagctttcacgtcggtatcgttagtatcttcagtatcttccagcagttgatcaccacgtcgctggcacgcagttggcagcttcaagaggtctgcgtcgactgttgtagtagacgcgtcagaccgtatctagaagcagtagaaatggtaagaaatgagtgggttgagcctagtctaatgtgacggatccaattccaggcaatagagcagtttcttatcactaggagcgatctaaattacaagagactaggctgggaggagaggagaagaaggaagggagccaggtcgctagcgaggcgatttatgcaagtattctgccgtacctatacctcaccgcttttctcaccgctcacgtgacgacaggcaagttgaatcgtcacatcagcaactatttaagggcttatatatactttagaaaactaatataagtttataggtcatataacttaaaaggctttagagtaaagtcatataattagtaaagtatctagtctatagtatctttaagcttactataacctatagtattataatcctcccccctttttaaaggcctaggccctaggctgttaagtcctttattctttatagtattatagtataatatctagttagtatattaggattatagttaggtatagttattgttatgagccaacaggaatcagcgctgtccaacacagcgatgtgttacgcgttgggtccaaccgtagtcgtcgatacttaacgatggtggttagggaaggatcaaggagtcttcttgactctgtgtcgttcacgagcacgcgacggtctaaccgacccgggtctcctcttcctcgagacaacggcctacctggcgaagggctcttcctcgaacgacttctcgcgatataatggggtctcgcaaagatacacgataggggtgcttcaggtgaacaagaacgataacgactaggtcagaggcaacgcctactagagctataccgaagtataccactagtagtaagaagtcttactgacccccaaagtaagtatcttagtaactcaggttaaatggattgaattgagcgcgagtaaggaaaggctagatacatgagtataattgtccttatttatgtttcttccagtcttccttcggcccccctttttattgcactttatcaacgcaccacgccatggctgatatatcaaaagaaggacgtatgcaattggcacttgatgcctataagaaaggccttttttcatcaaaaaccgcagctgctaaagcttttgacgtgcctccaaggacctttatgacatgtgtcaatgggactacttctcgcaaagattcaacagcaaattgtcgcaaattgacagatactgaagaaactacgctttcagcatggattcttgatatggactgacgtggcttacctccacaaatatcaacagtatgctatctggcacagttattgctttctgcgcggttatcttcatcagaagcttctgttggagagaaatgggtgaaccagtttatcaagcgccataaagaactttgctccaaatacagccaaaagtatgattatcaacaagccaaatgtgaagatccagagcttatcaaggggtggtttaaacggtttcatgatactattcaaaagtatgggatcgtggagcaagatatctacaacatggatgaaactggcttccaaatgggtgtgatatcaactgccaaagttatctgcagatcagaaacaagagagagtcatgcaaagattatacaacctgggaatcatgaatgggttactgcaattgtagcagtaaatgcaatggatgggccttacctccgcagattattctagctgcaaagaaccatcaatctcaatggtataaggttgtcccaaaggatactgaatcagcattagtaagaatggctggacaaatgatgaattaggctttgaatggcttcaggaaatgtttgagaagcatacagcttcccaaactattgggagatatcgcctgttgattctggatggtcacagcagtcatgctacagcagaatttgacaagttctatacagaaaggaatattattcctttatatgccaccacatttgtcccatctgcttcaaccacttgatgtgagctgcttctcaccattaaagtgcctatatggccagaagactgaggaggtgatgcaaaacagaatccattctgtggataaggaagacttcctatatctctatcctacagtccatcaacatgctttaccatcaaatattcgaagcggatttgcagcaactggcctagttccattatcaccagaaagagtgctttcaaagcttcatatccagctaaagacaccaacaccaccggtgatctacagcacatagcaatcaatcttttaatggcccaggcaagacaccagctaatatgcatcaactggagcagcaaaagaacaaattcaacatctctacacacacacacacacacacacacacacacacacacacacatacacacatacacaaaactattggaatgggatgggatgcgtactaggcaagcaatccccctgaaggatttaattaatgagttgtttgtatacacgcgggagggcgaatatagtacgggtttccttttcttctatttttttatccttttcttttcaattttcggaaaaagaaagaaggaaaaagggaccaaaggggaattttgtttttttttttaaaaaaaaagagcttctgcttctgctttgcgtatttctttttttttttaatttcatattttattgtctaggtacttggttacttggctttgctttgcctgtgtgtgttcactgataatttatttttactactgtactggtaattatttttttatcttaaacaagtaaggaagagggattaattatatgcccatgatgattgatggtggtttaaccctttatcttctatctctaacagtctcgtgtctgtcgtacgtacgtactgtactgtacacatcatcacatccatcacatccataaatcacatcacagatcgcatccgatcgcatctcatatcatatcacggtcttgttgaattcaaaaggtcaagactgaagactcaagaattcgaatcgaaaaggtcaggtactacactacctacacaaggaacaattaatatttttttttttaaaaatcatctgctggaattgactttttactttccagtttactcctcttcctcctcctcgcccttttcttcatcctctttctcttctgctgcctcgtcctcttcgaacgtgttgggcgggacgctgtacagccggatgaccggcttgttcgggtccttgacgaggacgtacttcttgatcttttcttcttcgtcgctgcgctgttgctcctgcttctgttgctgctgcttcttctcgccgctctcgccctcctctttcttctctccttcgccgctggcgccttcactggcaccttcgccttcgcccttgccctcgccctcgccttcgccttcttcttcttcctcgtccaggctgcggattaggtcgacgatcgttcgcacaataccccatccgttactcaggttcaggttcatctgcgccgcgaattcgcgcggcttgtagcccaccacgcccaggatgacgtgcgccgcggcagatttcgggttggcgcgcgacacgaaccccagcttcatcacgtccgccttggccaggatggcctgcgtcgtccaccgcgccagcttgcagctgttgttcttcatctccgtcgccacgacggctccccgctgcgacgccagtttggtccgccagtccagcgcaccgcctgcaccttgggccttgtggtcgaactcgttcagcgcccggatcaccagctgctggttctcaccggtggagctcttcaacaccgcgtcgacttccgtacggacgatcaggttcagcggctcctcatccttctcaagcgacaggtcgaaccgccggtacttgtacgccttcgacgccagaggctccgtctcctccgcggcgttgtagaacgggttcgggtgctcgaattcaaccttgttcgtgtctgactcggacaccgtctgcagcgcgaagttgtggttgataaatgtcgcctccagggccagcgcgctcggcgtgttgatcgcgtcctgtttgccaccggactcggacacttccaggggcgcatctgccgcgttctcgttgaccgtgaccaggtcgatcgaggagccctcgcgcttgtcgaagaaaatcttgtcgccttgcttgacaatgatgatatcccacgagtacacactgcgcggcgcgcacatcagcatggacaggatgtcggccgtggcaaagacggtggcctcattcttctccgcaagctcttggattacagggtcggacgaggtggtcacgttataggcagcccgctcgagggactgcagcttgcgctcggctcccttaacgggcgccttgtcgtacgaccggtcgtagtagtagaggaatccgtagttctcgatatcgtcgccatcaggcgtctccagatgcagcttcgacagccggttgaagtcgacctcttcgagcagggtccactccgggcggatgttgacggagctgtcccggttccgctggggcttgtcgtagtccttccatccgaagcgacgaccgcgtccaccgcgggcaacgcgctggtcgtagataccagcctggcctcgcccagcaccgactctctggaagccagcccggccgccgcgctggagggtgccacgctggccacggccgcggaagatggtgccaccgccgcggccgaaaccacgggcctttgcagacgtgcgggtgttgtcgacaacagagaaggaggactcgtcttcggcgacctggacggcgaagagactggaggttcctgcgccatacacctgttggtcttgagagacattagcgacggagtccttggggaaaagaccacagaacaaaaactcgccacaactcacctctgaaattccggttgtaggcctgtcggccaccgcgttcacgatccttctctgcagtccagtcggccattctgccgagcttgtcgcccttggagaagggggcgtagggcacgccatcgagggtgttatcggtggaggtggggggaccccaggagtcctccgacgggagggacgagacgatgttggccagagaaatgggagccatggtggtcgatatggaggatacgagacgtaaggtccaaatctccctcttcctgtcctttctgaagggtgagactcagaaaggagcggccaggaaatgataaggcgggaggagtcgacgattatcggaataatttcgagtttttgtgctttgctcgccgcctaattagtcgcgcgcttgtgggccaaaggcgtgtggcgggctgccctcaccgccttgcgttctgccggcatttcgtttaccaaaaacatttagagcccccaagttactaggagattctcatctgcttccatcgacttggctgacaatttctacgagttctacgttgcttcatacagatgcatccagaaatgaaaagaattaaattcgtttcagacacgcgacattacagaattgatattggaggccaaaaaagtcacagtcagatcgtggccccacatgctatatacagaaactgacacgaatcaaggaacataaactacggtatatcctgaatattccagtcatgtacatatcgacatgatcatggctgcgtgaaggacgtcaggttggtggatccagcgaccacgtactgcttctccgtcttgagctggtccagcgtctcgttgctcagacggagactgtcgcggatgatctgcttcgacgtcgagccgatccactgtccgagggagatgtctggtaacgtcagcgacaagaaaaggaaagaaaagaaggacagggaaagaactcaccgctaaagtgatcggcttggagcacctcgaggaatatcagatccgtgtcgccagtgttctcgacatagtggctgttcgacctgggaaagtaacctacatctccctggcgatagtcgaacgtggtggcactgctgggcgccgagaagagggtggcacgggctttgccctggatgaaaaacgaccactcatcactggacggatgccagtggatttcgcgcatgccgccgggcttgacggtaacgagggcggctgagaagttggacgcgatcgggaaggtcaatggatcgacgatcttcacgctgcctccggggacctcgtgagcgggctgctccgagaagtggtatgagtagctctgttccttgggaacgctgcccgctgacccggtgacattctgttcttggatgtccttcggtgctggggttcccgggaagatgtagagctcctcggtgggaatgttgtcaaaggcggcgatggggacgccaaagttctttgacagcacctctctctaccccgagtcagctcgtcgttcagtccgtgcggagccttttcttaccggttgatgggagaagacgtccgaagttagaaaagtgttgtcttctgagaatgagccgtcgtcgaaaaccagaagaaactccgttccgttttcgagagcctggatggaatgaggtacgcctctagtgaacagtcagattcacgtaaatatcatcggggacttcaagacttcacatacggcgggaagaaccacacatcgcctttggacacatcgtcgatgaatgtctggccctcctcgttcattgcctgtccggtcagctcaggaacgcgaagttagactacaacgagcggcttaccgcaatcctggcactgccgttcagaaccagagaccactccgacgcgacatgccagtgcagttcccggtaggcgcccgcctcgagtctcatgtcgacgccggccatcgcttttgcagccggcatgacctctgtattttcctgtcgcgcccaaccggcgccattgaggccgagtctgcataagttagacgaacgaaatttaaaagatgcgtcaaggctgacctgttatgactgaggcctgtgaacggtcagtacgcagatctgtcagatcaaatgggatagacgtacccatcggccactgcgcgttgatcgtcgagccgctgtccgttcctggcggggcgagcttgtcgctgttgatgcggtcgtagttgtcattgcctttttctgtcagcattcgccacgtctgggctggtcggagaccttacgaggaccgggatcggttcctcccttagatccgcggatgggctgcgggttttccacgctttcgaaatcgagatagaagccgtcaatggcgtcgagattctgtccctcgacgggctggtagggaacgtcgtcggtgttttccgtcgtcagcacgttggagggagaatagcccaggaggtcctcggagcctctcaggggagggttagggctgctgctggcggaggcggacgagacggctgcaggggcgccattggcgaggggaaggattgccagcgagagcaatgcgccggagaaggcgttaaatcggcccatggtggaagaaatgtcgggccttgatcaggaactgttcttgactgtgaccaagtgtgtatgagagagtcttctggcaaatgtccctcgtgacggcatttctcactgaaaaattgcagatcatcccattctttatattcgcagctctattttgttgatttacgtcaagccggaatggtcggaagctgacagctccctctcctcatcttgtgtacctaggcattgcactcgatagcagtcactgtcaaattacccctcactgcacgcaaggagcgattaatcacaccgaaacaaaagcatgatgtcttcaagcattgtgctccacacttgtccatgcggatcaatgacgctaactaatgcagactactctagatctatgtctgctgccaggtccgagcagaaacctgattatgcatgcaatactaagttgcaacactgcttgcaaccctgccttgagggatcgttgaagacctctgtcggagtttttttttctaatggtatatgaaggagattaagggtgacgtgattgattaatgttaacagacaatcagacaatcaatcaatgatcattactacctgacacctgctgctgctgttgctgctgctgccacttctggctactaccacctatcgaaccgggttgtgagacgattctccacatatcgatatactaacttataggctatgatctaattccctcgttccatttttagcccatagcaagtgctgaccgtatgtacagtacagtacagtacagtagatacatagttactgcgaaggaggaccacaggcagacagatatctcttctctcaacggagttacattccggcataattttcggccgagacaagcgaacttccctgcctacaaagtacctaggtatgtacgttacatacataaggaagtacactgtaggtactgcagatgccagaacgtgggacgtcccgttgtttgacattgccaaactgcttaagcaagactaccacgagccagcttctgggccaagctttaaaacaaaaacagtagtgcatgacaatgacgaaaaaaaaaggagtttcgatgggtcgtccttgctattgattaacttaaagttgaagaaggactggaaggattcaagcttgtttgtttatcgtctccactcgcccagccatctactcactcacctacctgactaggtaggtatgtacagtacagtacttacctggctagatcatttcgcgcgaattactgtcgaccgtcgatcttattgcagggaatcaattctcttggatttatttttaacattgtttttcttattaatttagattccgcgggaaagacggcttgctttccttcccctcatcgcatcggcaaggggtggtagactctagacagggacagggacccttggcagttgtgaatttgtccccgcacgaggggtaagtaatactatcgactgtacatacgatggatgactacgtaggtagtgactggctgcttggaaagccagtgctgaataggtgggtggtatgattgttgtatctaataataaatccctcttcggagtgttgcagaggctgggtcttttgagaagggagagaagaatatggagaaagtaatgctttctttctttctttcttttttttttgaccgccaaggtgaggaggtcacaagacaggatgtctgtacatgtaggtacctacatgtgatgagggctctgtggaagatgaagaaacggcttgattcctacaaacagccctacgggccgcaagcctagatataggcacccgcgggggcggtgaggcctaagcgagccgagacatgcatctgccggatgcctggggcattcgtcatactgtacagagcgtctagaaatggttgctggtttacggagtaaaaaaggactaattaactactgtgtgcaataatactccgtagctccccactcgtcatacatatcatcggaagaaaagggaaacttcaaacaggaataaaactgctccgtactctccaagtccgtcgacagcattggcattattttcctacagagaatatgatagacatactccagtttccgtatatctaatgctaggctgcaggcatcaacattccgattatcaatcagatgatcaacctgacgaagagggtaataccctcacttgtcccgtcgtcgctggtacggagtaatctatcctgggggggatggaggtagtgctgctgtccggcacgcagatcgcgtggtcgattgccgaatcctgagaccgttgaactcgagcaatgagcatattttgctattaatagtacccgagtcctggcgctggtgtcactgcctacggagtaaggacttagggatctgcaacaagtcctacctgctaaggaagcagggactacggagtagactactagctagtctagattgcagttctgtgcggcaattattattctgtctggacagatgcactgccatgtactgcacatgtactgtactgtacgtaggtacatacatcgcagagaccggtggatgtcttcaaatgacagaccacagccgttatccagacacacgatagcggtgagcacagtggctgacctatgtggggtatgtcgaaaagcttggccatgcctaatcgctggggtttgacctgtcatttagtgagctaagagcattgatgccgataatccgattgtccattatttttccgattctagatctcgagcaaggtcctctgtccagctccacatccacatctgcatccgcatccatccatccatccataggctctggtgtaatctttttttcccgtcgtcgtcatagcttaactcagttggaggagtggctctcgcgcgacactgcccaagaaggcaggtagatgcccatacggtgcgtaagcttcaggatatttattattgccgtcatgatagaagaatgacttacataatatgaaatcaagaaagaatagaatagaatcgaagaacaacaattatcactataaatgcggggtaataatggggagtagtatgtcactggcggataatattagctggaagttcttttttttctttgatccggtttattattacaccacaactgaacctgtacggagcatgtacacgtaggtacattggtaggaagactcgctacccatgtactgtagatgcctacgtagtaccgaatatagcacaagacaagcatgggtagaagatacatacaatccagggtctacatacagtgacgtccggcaattctttctcccgcccgcgtgtcaacatcatccatctatccctcatccttgcctgtctgtctatcttcctcgtgacaataatagtaacaatatgcagcaagatcaggattctgtaacattaattaatattaataggacttggttggtcaggtttgcgcacgattaatatccagcctgatcacagacaagactaccgttagatgagaggagaagagaggagtagagaggggaagtttcgaaagggaagggacatggggaaagaggtggtgtgagccaattctaccaaatctgacgaggcgggtaaaaacataattacaaaatgcggggaaggactcaaggtagagtagagtacctcaggtacatacatatggaatgtccttctgtcattacgaggacagagttggagagctcctcgtggtggttgagtaatataaacgtggagattaagtataatgtggggaaatatatctaaacatggaacaatctttagattcttgggtgctttgacatgcacatggtggctacctccgtctgctcacgaggtactcgtgctggagattcaggataggctacctggatgccatcaatagtgttcgaatgaatgcgatctatcagcgcatttttcctgacaatgcagtgataaatcaacactgtcagtccctcaggtgatgtttccattaaggactaaattgcgagtagaactcttctgaataaattcttttaaattctacagggatttcttgtcgacagggaggttgggcttctgaacgagatgctgtcgttcaattttattttcttctgacctatataatcttataagagtagtagaatgcctaatctagatttccttctactcatctatctttaagatatttttagatattgtataaatctagttttattcttaagttgtataaaataaactgcacgatagctttatgctatttagacagccagctagatcttttaattaatactccccttgggtaaaaagaaagcctctttctctaaaagcacagcactcatcatagacagtatggaattagaatctttcctgcttgatctggctatttgggatcctgcactgtctctatgtgataaccaggggtaagttgccagtcttgattttccactggggaataattcagcggatatggtccacacatcacttctggatcctatattggacccgtttattgcaccgctcacttcactgtctctgccttcaaccggtatggcagaacctggttctggtaccgatagtctggaaagtttagggtcagggtcagggttaaccttaatattgcttggtggaatgctctataagaaaaattcaaagggctttaactaaaatattctatttaccttcgcatcagcatctgcctccttgggaaagcagccactaagccctccaaaggaataaaagaacgggttctcaaggacactccttttgatgccatttcaagttagcctgcaggtgttgcagtggaatttatagtctcaagaagctctagatgaaatagaagatatcctggaatgaaatgctactggaaaggctcaagtctgctaggccatgcttccatatatcaagagaaattgatagggaccaaagaaatgggctctattcgaaatgatgatattttcaagaaccagaggagttagctgatccgcaacaatagcaattgtatgaaggccgtcacatacagactagagcgctattatagacggttcttcacatatcgtgcgactgatataatccctgtcaacaaggatgattgtgtgacttggccaaagatgaatgcttcgcaatatccgctctacggattgatctaggcgttagccccttgaagataatttagaagttgccaacaagactgtattacagcatagttgactgctgcatgtcatagaacatgaaaaggtggatgaatgatgatggcgaatgtcctatcataatttagactgtgaaaaagcctttctagactccttttttagaatattttctcttcgatgactcatgcaaggccgggaaataaaatcaattcactgcatatcagtattctagattcagacttacaaagattccatatgacatcgggatctagtgaagacagtacttgatcaagcccccacgtcagcctacaacggagctactctcagaaagagtcatatcaagagtcatttatgccgacatttaagagcgtcaagtgcccacggtcgggaggaacagaatcacagacctgaggggctcttcaggattcctaaattttatcatggcgccggccataagattctccagtactgggtcgcgcctgcgagtgaaattgaccatccctgatgtggacgtgcttcgctatttgaaggatgcggacaaccaagatagtcgtttcacggggatgaagatttcgccggagcatttggcccaggctgaaatgcccatatccctcgtaagtcaatgcttacggacctgggataagatcctctcagaattaccaatctccttcgtcatgctactgaggactagcgccctctcttcccgggaccgggttacagaagaagccgaacggattgaaaacttatcagacctcttgcagaataaagaagcccccctgcggttgagtgatcttccattggagatacttctgatgtatacgattgcattcagatccttgccagcgcaagtgggttccaagggctgtaccccgtcggagatctgcttcaatttggctttgcaacatctctggcgagtgcacttagaggcagacgagatcgctgtaccgtgtatgctaatcattgctcacatattcctctatatcttcgcgaaaccattttatgctcttggcatgctccagagcgtcgatcctgcaatcgaccggctctcaaagcgcacagatcgcctgtatgtctgccacttgtactccctcttgcaatccgtcctgacgaggtttttacaggcctgaaatcccagtccttctattaagtcaagtgttttatatgctgcaaaggtaaggacacagggcgctgaatcagacattggctattggcctgctttttcgattagtctctaacgacggcgacaattattctcactgagatagacggcacaccatcgactagagtgccacgcatgctacttaacaacagtgatgtccagtcaccaagcctgatgcatgatggacgcctagaggccggttcaggccagtcgccagattactactacttttctgcgaaccttgggctccgatcatgtctcaatcgaatcttaggtcggatgttcatcacagatcaagcctattgccagccacgagatgttggccctgtgatcacggagatctctctggagatcgagtcatggtatcggtccctgccgcttgatctgcagtatgttcgggacgcgagaagctttagacttctcactccagctatctcgacacgtcagaaagagttgtccttgagatatcatgcctgtattttcttcctcaaccggcctgtgctctacttcgtcctataccaagatctggaacatctggcgacaaccccgccgggaggggtaagtgctgtcgcagagcagcatctaaaaccatgggtcttcgcttcatgtcgggactgcatcgaaagcgccaagctgatcattctcactttggcccagcatcagcgtcaggtgcctatgccacgggctggtccaaattggtgcgacatccagctgctggtcggctcttatgccgtcctgctatcagtgcagacggcaccttctttttcggcaccattccgggatgtcgccgagatcggtgaactcttagatatggtagaggaaattctgtctggggttacagaaacttctcaaggcatcctccggaccctggaaattttgacgaatatcagacacaatttccagaactcgacacctttgacagggaccgaatgaaatcaactctgtggcaataccttaaaggtcaacgtggcacaatttacactttgtgaaattgaaacctggatcagcgttcctagtctagttctacggctcttctacttgctcacacatatggttcttcccatccaaacttctcttatcttcatcgcgactcagttcctcctgtggaaagacatgggttcgccaatggcgcaccggaatccttttctcaaagaacaaggaaacctccaggatggatcgacccgcggtttcgcccatgcagaaccagatgtacagcagagagatcacggtggtgccggcatagacaaatcccagcatcggtcccagcttctcactgtaatataggtacggtgcggtaaaagagacgacccaggttgtcagaaagaacgtgatgattgagcatgacatgattttgttccggttcgggcccacagcggcttcactggccaccgtgtaggccaacggacccaggccaaagttaaacgcgacgatcaccacataactgatgaccacgatcgcaatcgcaggactcgtggtgatcggtctggtcgcgattccaccgatgatgatgatgtacgcgcagaacatcatcccagtcgtcacgagaagattcgtcgggcgccggaccttgttccccaggagaacggatgcaccgaccgcgaacacctgcaggacgttggtgatcagggagatggtaaaggcctcagacagcccgatagactgggcaaagatcactccgtacgagtagaagaagacgatgccgttgatctgttgtgcacacatcgagccgcacgaatagaccagctttcgccgttcgatcggatctttcaacaataccacccacgatgacgcggcagatgctgcttcgtgacggtctctttcccgttggacggcttcatccaacgcggcgaggtcggtggccgggtcgtaagaagggttgcttttgtggatggcgcgaagggctttctccgcgtccgcgcgacggcccttgttcatgtaccaggtcgggctcttgggaatcaccagcaatcccagcagcatcagcgtcggtaggaggaccagcagtcccatgggaatacggtacgatgcggaggagtcgatgctgttggtgccctggtcaatgccagaggccaccaactgcgagcacgactgcatgaactggaacatcattaaggccgggccgcgaacctgccgcggcgcgatctcaccgatatacagcaggcaggtgacggtgaagttgccgattccgtttccgatcgggagccggcccaggatgatgacgccttcaatgcccgttcacttgggcaacacctccggcgatgatggagacggaggcgaatagaaaaactgcctttcgaccccaccggtcgttgatcagagcagcgaggagcgcgcccagcaattcgcccacgaagatgatggatgtcgtgacggcggtaaacgaggtggcgaggaccttctttccggtggctggatcgagatagccatagtcattcttgaaggtttgcatgcccagaatgccagtgtaatatgtctggtcatacccgtaacagagggcgtctagagaggatacggcgcagcagaagatggcccatcgataggccttgaagtttgtcttgagcatggaaaagccgacagacgagaaaataaaaacaaaaacgatatacacgctcgagcaatatcaccggaaagatcacaatgggcgacatggcatggtcaagagtgtcgtggttgatcgttatggattttatactactccgtactgccagcagcgagcctcctccgttcttccccagtccggggtaagaattctggggtagttagccatgcatgcagctgcagcagagtggaccgggcttccttcgacccatcagaaatgcgcctccgcaacttcgacatccactgacagtccgctgagttgcctgattgggcatagggcttctcgatcggaaggctccgtcggagcattccccgaagccagtcagtcacgccgatgacatggtgatgcagtgagtggagaagtggatggttgtcagtgcggtatcgggatttgttttgagctgcaatcgctggtggacaatagacaagccttagggtcgctcagtctggatggttccgccaacaaggactccgggggtctggacgctcctgatataaatcaggtcgttagcggggtcttctcttgactgcctgctttctgttcgaattcccctcttttctcacccttcggatcgcaatgccctacatcgtcggcctcaacagcggctcctcttttgacggagtcgacgccgtcctgtgcaccatcgacattgatcaagatggccatccgtcacgacccaaattcgtcgacgctctgacggtggactggccggatgagcttcgcccgttggtcatccgagctttcgacaaccagctctccctcttcgacatgacgcgggtcaactacgctgccggagctgtgtatgctgaggccaccaacaagctgctcgcgaaggcgggtgtgaagccggaggaggtcgaggttctggggtatgacggtcagactgtctaccaagaaccgccagaccgacaaaagattgcggactacatatccagcggcagtaagagtctggtggacctctggacgaaagggggcttcccctgcggcttttttatcgtcgagtcgggcgtggtcgcggcgttgactgacatcaccactgtcacccagttcctgcccgtcgaccacgctctcggcggttcgggggcgcctctggtgcagtatctagactttgttgctttccgtcatgacggtccgactgtgacgctcaatatggcggtatcgccaatctgcagcttgccgacgccgatcgcagcaagacgatggctttcgacaccggccctggcaacgtgatgctggaccatgtcatcagagcgcgcactggacgatcgtacgacaaggatggcgagatggcggctcgaggacagatcatcgagcctctgctggccgaactgcaagctcatgaattcttccagcgcaaaccccctcgctcggcctggcgactggactttggctctcgttacgccgatgacattctcgagcggtacgcctccgcttccaccgaagacctcctggcgacattggcgatgttcactgccacctcgatcgagcgggcgctggtggactttatcctgccgaaaacgagcgtcaccaaagtcgtcgccagcggcgggggcacgaggaacacgaccttgatgcgattcctgacggagcgccttgcgactcacggactgaagacgtgcgtcagcgacgaattcgggatgccggccgcgtacaaggaggcgatcaagttcgcgacgctcgcttttgcggccaagagggggctcgccaacaatatcccggcggccagcggtgcgtcctcgtttgcgatcttggggaagctgaccttggcgccaaggctggcccgggggacggaaaatattacttccaatggtgtgtcctcagtttagatggtgttttgaccttggtcgagtcccgacttttcgtccggctggatgacgtgtggtgaagccaacgcctgcaggacaacttcaagttattaatgagcaaatactttcgaatctgtagaattatcatgaggtcttaatgaggtgattttctatagacctctttatcgatgatggatgggctggttgatagtcgattgtgtggtattaccatagaatagcgatagaaagcaggcgagcaagcaagcaagatatgaaacattgtctatactccgtataagtagtatgaataatctctgcttgtagcagaatgaaaatcctcttactcccgtcatgagagggcaggaaatatcatgatggattccaggcttataatgccatcaaaatacctcagtgcacgaagggtctctccttggcgaagaagaataacctggaattgcgtaatgaagccttttgtttatagtcaagtccaacttgtttgttttcgaaatgtatctcatcagataaacatttccgtggccgttttacccggtcacgtgactacacgcagatgaggagcaaaaagaactagcttggggctctccaagaagtgaagaaccggcgggggctaataacggcccgctggagagctctctactccgcatgtttgcgcgttacgattggcgcgggaacaacaaatgccgaactcaacacatcgcgtcgaagaatgctttcccacttggcacatgccacatggtcgacggccacataatgcccctcctgctaattagcaaactaactagtcacctaactagttgcctacggcgtactcaccgtctgtcttcagggaaaataacgtaatcaatgcatcgaatacccaataagacgttgagaaataggcctatcggtaacctgttcgagtaactagttgttatcttttttcccttttcggctcgctacagatgcgactaacgatccaatgtccccgcactgaaccaaaggccgtggcaatccatttcggttataaaagcgctaattcggttacaacccctgtttgagtccgtcaatgttgctcttttgttgcttccttgtgttatccagtaaccataccaccgggactcgacacgaccatggcgaaaactccagcgcaaaaaaaggagactactggccaaagcaagcctgccagcccaagcaagcctaccggcgaaagcgggcctactatccaaagtgaccggaatggtgaagatcccatcgaggtggactctcgggttagtaaaatgcaaccaactcagtgtgatctctacatttccataacgatcgtgatttctaacggattttgtggacctcaggctactgacaatgattctgcttacggagaggagctgttcgtgactgcttttacctctattgcagccatacagtacgactgacattttatgtcagttccacttatactgcttccttgacctcttccgtgcaggactaccgtattgagaatggcaggcgctaccacgcttatcgtgatggaagtaagcccacctatttcccaaacgaaccaacaatcctgcgtctgattcggtatccttgctaatcacataccctcctggtagagtacctcttaccaaatgatgaagacgagtccgatcgactagacatggcacatgaactgtgcctgaaggtgatgcaaggaaagctatttctggcacctattgggccgtcaccatcgcgggtcattgaccttgcgactgggactggaatatgggcaattgatttcggtaaggagtggtcaacaatcctattattgtgcttgcctgagacttacctggcattattctgcagccgacaagtatccttccgcagaggtaatttagccttctactgcgagagaaacaatacagtggctaagatgtctctttaggtcattggcaatgatctgagtcctactcagccaactatgtaagtcagcaatctccccaaccccttcacccctggcgctgccatagttgaaaaaagacagctaataaataatcctataaagggttccgccaaatgtaaaattcctcgtcgacgatatcgaagatgactggggatacgagaagactccatttgactttatccatgctcggtacctatgccactcgatcaaggattttaagaagttgataagacaggcctataagtaagttcttctctctactcgctaaggccactggcgaaggctctactaatatgattgatgatcagctgcaccaagcctggaggctgggtcgagttccaggactgggattgccggattcggtctgaggatggaagtcttgagggcacagcccttcagaggtattatacagaggtagtaaatgcctttgagagggcaggatacccagcaagccccgggcgatatctggaagagtggttccgtgaagccgggtttgtggatatccatgttcggaaataccccgtgccgatgagtgtctggcccaaagatccatattacgtatgtgatgatttttcctcctcctcctcctcctcctcctcctcctcctcgtttttcccttcttcatttactaacgactaacagaaagaaatcggcgcttggcttcgcgtgatcgtctcggaagctttcgagggaggcgccatggccgtgctgacgagatacgaaaactggaagccggaggaagtcaccgttcttgctgctggggctaaaaatgacctcaagaatcgcgatatccatgcaataatggacttgtaagttaattattgatctggcttttagtattatttacttccttaagagacctaactaactgctgctcttagctgggtggtgtacggtagaaagcctgagtgaactacagtgcgccattcattgccgtcgggtgctatttactacccgcgaagcaaactgattttttttttctttttcgatggtatcatattgacgacacctctccatgactttttcacgatgttcttctgatgtctttccattcttttttgtcatatgagagcccctatctagttagtcatagaattaattgtcttgtcgaaaaaaaaaaaactgaatctatttggttgccgtaactaagatctaaagctgtagaagacaagaagaaagagactacctacccagtataaagtactgtaggtagagtcctttgaagctccttttgtccttcgccaccccgtccaatcatcgaccagctagcaaatagacttaactagcgcggtcctccccgcttggctccgcacgtgcgaagtttactgtacttgccactggcatgtgaagatctactgattgatatttgatagctgacacagagaacaatacggagtagggcgtatcttcatttcttgatatttttagcagttatctggtgcagcctattgctatctattggttacctatgcagctgctcctgtcacgtgggcttcgtcagtggcttctcacgtgacccggcgataagcgcgagcacgtgtctcccgagattagtcggagtttcgacctcctggaaactgtgaacatccagactcagtttcgccttttctttctttctttcgttcttcggtatatattcatctttttttttttgcttcgtctggcgtcctttggagaaattcctctttccgctgttactggatttcaatgtcaatgtgacgatatcctaatgataatgctaataatgccgtgatcatccttcgcccacgtgaacatgtcacctgccaccttcgcatcgacctcgacctccgtccggcatggaaccccctttgcagcggccctccgctttcaccagcagaagctgtcgttgcgtcgtcgcagcagccaagaggacgaaaagaacgccgcggcgggagatgctatcgtccagactgttgctgatggggaccagaaagtcgtcgtcccggacgatgatgatccatcgccagagtcttcggaggtgacgactgaaaagcagctcgagatgcagcccgcgcgtcgattcgatgccgcggcgcacacccacccgctcttcccccctcttcctacgtacggtcctccgtcgctgctgcgcagcatgcaatggcaggctctccgcgcgatctccttctgtctgtcgctgtccttcctgggcgtcattgtgatgggttcctgcctaagtggcgtttcggttggattgagaaacctcggcacgagactatggcggcggaacccagccacacggcgacggttccatgaagaagagagggaaaggaggactgctaggcagaaggcggcaagaaggtggaagcgtcgacaacggaagacgctgggaaaggacctcaccaagactttggagactgcagaggatgaagattgcgaggacggggctgctgaagatgaattcccgccgttggaagggggaaaggacccgatcgtatgcgacgtgggatattatgcgaggagggttggtctcgatgtggagacgttcaaagtgcaaacggaagatggcttcatcctcacgctgtggcatgtctacaatccgaaggagtatacgccgctgccggctgagcagagaggtccccgtcggccagacgtgttctacgacaaaaatgagagaccgctcccgtcctcgaaccgccggtaccctgtcctgctgatccatggcctgctgcaaagcgccggcgcgtactgcaccaatgacgacgacagtctggcgttttatctgtgcaaggccggatatgatgtgtggttggggaacaatcgctgcgggttcgacccggagcacgcgacgttgtcatactcggatccgcgcatgtgggcctggaatatccgccatatgggcgtgttcgacctgcctgcgctcgtgtctcgagttttgtacgagacggggttcgagaagctggcgctggtctgccacagccagggcacgtcggagacgctcgtcgcgctggccaaggaccaacggcccgagctgggggagcgcatctcggtgttttgcgctctggcgccggctgcctatgcggggcccctgatcaagaagatgtactttcggttcatgagcatgctctctccaagcatgttccggctgtgctttggcatccacgcctttatcccgttcatgatgaccatgcacaggcttctccctccgcgggtctacggcgcgctggggtaccgggtgttttcgtatctattcggctggaccgatgtacgatgggaccgggctctgcgcgaccggatgttccagtttgcgcccgtgtacgtcagcgcggagagcatgcgctggtggttggggcgagacgggttcgcgcggcagaaatgcatcctctcgacgagggagcagggccagcaggaagaagaagaagaccggcggtacgcggacggactcgtcgacgtcgacgacagcggcgaggagcgtggctcgaacgcatggtacggtccgcaagtacccccgtttgcgctgtggatcgcaggggccgacgacctcgtagacggacggcgactgctgcggcggctgcagaacggtcgcgagccgcacgtgcggctggtgcactggaagatcatcgacgagtacgagcatctggacgtgctctgggcgatggatgctattgagcaggttgggcgggaggtgctggaggtgatttggcggacggtgccggaggatgcgagggctgtgtgtcgggttccgaggggttgtacgtgacggtaggtatatatgtggacataatattacatatactatagataatgtgaatgtactgtacatacataaatactttcaaatgtgtcagtacttttttttttaattttctaagcaagagcccgcctgtttgttcgcagtgtgttggatttttccttttctttccgaccctctgtttattcttagtaattgatatcaataattctcctatatttattttaagggcttatttcctataagaactggcaacatagttgaatccttgttctcgttaactagagagtttactggtgagccattttatctgatattttttttagctactctatctgatataatatatatagatagggcatgatcacatgttccctctagctctctagatagatttatgggaagtttgtgacaacgaaagtgatggagtctgtatattctcttcccatgcactcacttactggtctccctagtcaacatgaggttgcttcttctgacatttcgacacatgtactatagaacatcaacttcagtttgtacgcactgttacatgatttgtggaagctagaacccccaattgtaagcccccgcgaaggcgatggtgaagcccatagcaaagcccttgcagagcgaagtgaaacttataaggcttgtatatcatatataagtaaaaagaaaaaagggggaaaaagaaaaaagaaagaaaagaaaggttacttcactagatgatcatctccatcctgttatggcccatggcttcccattcattgttcaacatgtcattcagcaacatatacgcccgatggaagaggtgccattcgctcttcagatcgcgcaggatgttcaatttcgagatccgaaacgccagctggatggtcctctcatgatgttcctcgaaccactgccacagtcggtccagggtcctcatatccgtccgggtcatgctcgagggatcttgcaccagtatctgcggtctcacgctgcccagccagcggagacaaatgaaggcgggcagtattgtgcgaaaacgaccccggtgaccccagtttctcttcccatgccgagaaggggaagaagagctcgtccaaccaaattatggtgctggatggagaaatgaggcgtttttttttccacgtatgataatcatgaatgttcatcgagttctttttttttctgctctctcgctttctttcttgttttttttttcatcgagatattatcagcgagcctatttgaaagcaggctggcgccttcagcctttttttatttattatgaaggggagaataagccttgaacccctcttgaagcaggcgtgtcaggagaattcagccaggcgtatcacccacctggcgagctatcccattggcacggaaaaagtggtggccgtaagaaggatctgaccacctggtcattttattatttgcccgtatgcccgtgtgcccaagttgcgaagcgatcgactgcagacaaggattgaaggtgatgagcgcttcgtagtggttactttactccggagtacggcagccaacattggcgacactgcattagtgtatagtgtagtgtagaccaaccttgctgggacccgcctgatgggccaaattacaccaacgtcacgacgtgatgtaagcactaaccctgaaaaggatagccttggcatgcacccgtggacctatgaatggatctcgtctgactcctacgccggagtaggggtaatacagtatctgttttgacgtggtaaaggaaaaaatatcaaagttttcttaagtccctataaataaatttcctgtaaagcctatagcgaagccccagtgaagcccatagggctttattatagggcttatatgaagcttcataataaactttgtagggagccttatagggagctttatgggaagcttagggaacacttgggtgaggctttagttaaagcttagggaaggctttaactaaagctttagtggaaggcttcttagaattttctgagtgttctcttctaccatactaaacgggtgggggaagtcgaaactaaaccgaaaagggaggagattctggtagaaaaagctcttttgtgagaatacaactatttattccatagattatctgccagcatactgtcatgccctaactggactggctgtaatcaacgcgaggaaaacagcgcagccacgttgttatctactaacacatccagtccgtacaggccttggggaggatacagtagtagagcatgacgggatgtttaggatataatatggtcttatttaataactaagaatggtactagaactagttgctaagactcagcatccctcaaaagggttttaatacctttacctttagctacgtgtttggtctatacctaggttgtaaagctaatctacctttagtctacaagttctatgggccttgagtattatattcaccttttttcttttcttttcttttcttttcttttttcttttctttttttttcaataagcctagaccccaggctatatataagtcttacattcattaataagtaatcctctttctttttagcttgtatctctctatttcgcctacaaaaaaggactgccaaaagacaagtcagattaggggtctgatttgaatagttctactttggcaataaatgtagtctattagttcatcgtatattatcatagagattgatcattataattcaaagacaggtgagcacatacagcgatcagagaggagtgttatacaaggtattaaccatgagatacaaaaaaaaacatcacagagaagcactaatctcagcagcctttgccgctgccttcttgtacgcctcatccgccttgattcgctcagtatatgccacaatctccgggaacttgtccttggtgatcaagccaaattccgtggcagcgatgaggccgaaactcatcagcatgtcggctgcagtgaaatccttgccgcaaagcccaccacgcttgatagtgtcagtgttgtccacacctggggcagtcttcagctgattctccaagaacgggaaatggacagcgaattgcttgtccagaaaggaggtttggatctggttagcaatcattctggtgaagggtctgatgaagggtctgatgaagaacgggactggtgcgtttcggaggtctttttattaaagttagtcagaatcggtgagttatataaaacagtcgtatgtacgcactatttaatatcaatgccagcaacaaattcggcatcaagcttccctcggaataatgcatgaagaaccgatatcgcagccaggattcggtttcttcgccgctgccgtcaacatagcgctgagggacgaggcccttctcgacaccgccgaaatggtcaacgaggtactcgatgatattgcctgattcagcaagcaccaatggctgtgtctgccctggacgctcaatggtgacgacgggcgacttgccgagtggatggatctgtttcagctcggcgggtgcaaagccgtcagggccgcgcttaaagggtttcagctggtacggtaattgaagggcctccagcagccagaggatgttctgggcgcgagactcgttaagcctattgcaactggtcaattaaggaatattcatttctatctggggagtgaccacaccagtaaagcgtaatcttgacatcccgattttctgttgtgtcagccattgcacatacccccgttctttcgtgggaattgacgacggcagttatataatgtcgatttattatctctcagtgaaagaagaatgcatccgtatttaatcatcaaatcggcctaatctattgtcccgaatccaggcgtacggactggcacggaatggctgtgcataactagcgtacaacaattgtaccaatcacgttggatggtcggtatcatctgttggttttgactagccatcgcattcatctaggacatctctgacatgattaaagtgagtcaatcttagcaatcatttttagcacttaatttataagctactatgctatcattgctgtcagagtcaagctagtccgtgatgcagatcgggcttctcgactagcttctttttcaccttcgtcatcaatattccgctacatactatcctttcgatggactgttacattagatggatctctgtaggatgttggaatcagagctagcagtaaaaaaattaaataaaaaaatatattatgacctgatacagagtataatttaggtgactgcctaattccaactgctcgactatgtcgctggttcttatagggaattaatataaatccttaaaaaaacatatcaattagtgactacgaatggaaactactctgtacgtacgaaagaacttccaactgggacaaacatgcaggctctttcttagaaaaataaaaaaaatagctgagagctcacttctcacacatgaggcaccttgttttattttgacagattatagttcagactaccctactatttttttgaaagttgaaaaagaaaaaaaacatgcaacagctgggattcgctggtggtcacccacccaactactaaccagccggcgtgtggcttaagtacggctgagcggacgggaagccctgttttccacaccctatggtcgcatgtgggaggcatttctcgtcaaaggattatatggagagtgaaataagataggcatcaattagttgagcactaccgggttacattttaaggtttttatttttaggtagcctagtaagtattagagctggattctttccttaataacttcgatttcttttgtatactttgttttataagataagaatactataaataattattatttttacaactgactagctatattgttcattaaataaattaaagatatatctaaacgtagactaatatataagctaggatgcggactggaaaaatctgctaggcatacaaattgaccacttcaactgtctatacggcaaatctaaccagcttggatgccaggcggtctattctagctatgttccctcgcagcaatccacttggccacatcctcgtccagatccggctcatacagccaccgcagctgcccgccctcgcctcgcgtcgccgactcatctttccagatggcgcctggcggcagcttggcctgctccgccggcggcaggcgtttggcgttcatctgctgcgtgagctccagcaccttgtcgattcccgcctgtcggtagtcctgccagaacttcaacgcctctgccagcggcacctgcggcgacagcttcgacagcagcagcgccagcatgttcacgtcctcaaaggcctggttgacgccctgcccggccgtcggagggatggcgtgcgcggcgtcgcccacgacgatgacgcgatcggccgggctcgcccacttgtccagcttggggatgccgtagaaggcccagatgcccatgttctcgacgggcgcgccctcgagcgccgactgcacaatgtccggccagtcatccttgttctcgcgcagcatgtccagcagtccctgtcccagccggccttgtcgcgctcagggaaccggcgttgcgcgccgatcaggaggtcagagccgtcaatctcctgcggcacgatgagggaggcccccggcttggccatgacggtggccggcagggggaagttgtccgggatgcgcaggcgcgagcgcggacagatgcagttgatggccgtgaagcccgagtaaacgggcttcacgccgggagcgacgtagttacgcaccgtcgagtggatgccgtcggcgcccaccaggagggcggacgaggccgtcgagccgtcggcgaattcgaagtcgacgcgtcggccgactcggcgacgatgcgggcgaagcgcttgttgaactggatctccacgccctggtcggccagcatctgcttcatctcgttgatcaggagcttccggatgatgcggaaggcgcggtagccgtacagcttctcggagccaaagtagtagacgtcctgcacatggccgtcgccatcgcagaaggagagcgtgtcgaagtggaagcccttgtcgtagacgcgccggtacacgcccagcttgcgaggatgcgcagggcgtggggcgagagggtgatgccgccgccgacgtcgtaggattcggcgcgggcttcgtagacggtgcaggggatgttgacttttttcagcgccagggcaagactgaggccctatacaagccatgtgagatggctggcaaaaggtacgacgaggatatagttgcttaccgacagcccagcgccaatgatagcaacatgcttagggacttccatcttcacagctttgctgagaaagaagtagtttggatggagctgtgggagtgacgtgtgagacttgaggatggaatttccagtctttaataaatgagtgagtataattatagtcctggaaataagtataagctaggccgcatgcagcctattatttttttttccccactgcctgttcagtgtatcgttgtggtaagagatctgcgctcgacatgtgtctagacaatgatcatcccagggttgtgctgtaaccaaccctgtcatgatgaagttgttggcactatcctgcatagttaatcgtaaattgaaggttagctatgggtcaagcgccaactttgacaacagttagtcaagtttaattaattttaatcctatcaacaggtggggtcaatcagaggggcagcggggtttgcagaccaacatcatccagttagtatgtatttttggtgcataccagactatgctagtctagtatcagtatagtatggtatagtatgaggactgtatgcttcatatcgctgcctataacgagaacagcctacaagatgtctcgacgaggaaataaaggagaaaattcagtgagaagttgatataagctctcgtctatcctcggtagccaatcgaaaggggagtctctctgcttatccccttcaactatttataaatgagctgaaggtaaacgggtgacatgggacaaccaacttcctaagcgaatgtcgtaacatatgttggttgggtctggaagtatttggaccgaagactacgttgtaggagactttttttttggtagtttacatggctttgaatgacctagtgactatggtattccactgcatttggcccccacgagttggttggttggttggttgaggttggggtgtttgcagtcaagtccactcactcacttagggctggcagtatcatgtactgtactgtgttgactttaaaaactgacctataaagctaggaaaattattatttttttctttggtctaatttttttttcggcctaataggtatttccaacgtggacaacaaccctgagagattcttactctgcagcatcacggtcgacaataacacgtcgataaataatagtggcatgggtggcctgatgggctacctaggtaggtagctaatcatagcgattgatcaaccaataacatgatagataataggatgctggtgttggatcaaaggatcgaagacagtatctctactgcctgaactatgacaataactcactttatcttacgactggttattcaattattgaaccttttataaaatacagcagtcatttgaacactttccaccagctaagggatagcgcctattatcatatatattgtagtatactgtatttgttcctctgttccacaagctgagtcatctccagacggaacgttgacatatctttgagtttgatgctgatgctgtttatttccgacgagctttaggagccgtggtgccctatgtgatccagcatcatcatcatctgatgagaaatgggtattaagtggcattgatgattatgaatccaaatgtaattgcaagtatgattaccaacaagcgcagtgtgaggaatcaaagattgtcaagaattcctgtctaatccttgttaaaagaccttttttctacgcggacatcaaacatagatattttgccgttttactactcctcaaaataaaagagatcgccacgtctctgccttcataatccctagctttgagtaactccagcctacatgaataatgtcccaaggatctcgaactgctggatttactaacaacagagctaatgagcattgcccttagactggctgcagaaccagattccgaaccgtctttggttcatttggaggaaccctatggaaatccctccctgtgcttctttctatatggactacatcgttagcagttttgcaaattttgaccaataatttaaacttccactgtgaccatttctttccttacatcaaatgggctggacttaccctttctcttaagaaactcttatctatttatagataaagttgttgcattttagattaatgcctgttctgctgagattttaaaaaggaccatgtgctgctatctctagggctttctttaataggaaaaaaaattctaagattattttactaacctggtggctaataaattctgtactgatgatcctaataaatatatagttctattatgattttatattaaaataaaggtaactctcatctctaatactaggcttctcctttaatgctaagcttttccctgtaactaatatcagccttctttctattattaatacgagtctgcttttgcaagcaataccaacctcccccaattggccgccctcaggatgcacaccaggagaatccctatctttgtgaaccactcgtactggggacagggagctagctccccttagctgctgatcaacgtcgctcgtccttagcgttactgcctattcgacctctctgccttgcccgtcctatatatcataccctgtctggataacccctgtcttcgtcactaccaaagacgggcaaggtcgaacgcaagggcagagagcggttatcaacattcgaggtcagtctcaatgccatttaccgaaccagaaccagacataactgtccgattatcgctgctttggcaggttgtgactttatttttttttctgtcatgggatgtgcgatatcctatccttcttctatctatctatcgataaagctttcggacgcaccccgatttctgcagatttttttttttgattgtcgtggtcatctcccattgcggtcaggaggtcctcaaggttgcaccaatgcgttatttatatcaatagtgctgcctacatataacagaagaaaaaaaacctttctctcaaggctatatcgaagactttgtagttatttttttgtacgaggtctccacaaacacatcgattacctcgactagatctttcctccaaaagctacgctagcaccgccatagccctataccagattatagatagcattatgcatacatagataaagggggacaaaaaaagaaatagatgccatgacgttgggcttcttacttagcctgcaatgtgcaatgtgccttgatctccaatatgtattgtattgtatgtgcatgtggttgaattagtaggacaggatagaatggaaatggaactacgtctttctgcctaggtgggtaggtacagtacactgtccgaatacatgatgataagggatgcatctagattggaggctgaactagctgtaaataaagtaaaacgtcagtgtcattattatggtatgtcgtctatgggtctatgtctagaaaatagatcatctatatatctatatgaaaatcatgtacattccaaaaaaaatgatagactacgactccgccctctcgacatgatcggccgtccgcttctcctgagcgcccgcctccagatccgccagcgacatcccccccttgctcccatctgccacgtcgcgcacatcgcaaaagttgaccgacggcacgaagcccggcgactgccatgccacggggactttggcgtacagctcgtcgacctgctccagcgtcaggcccttggtctcgtagatgcagcagtagacgaagatcatgcagatgaagcagaacccgccccagatgaagaacaccttggactgcaggttcgcatttccggggcccgagttgaccatgtacggcgtcgcgtacgcgatcgcccagttgagcagccagttggtggccgtcgtgatggacaggcatcgcgcgcgcgctttcagcgggaatagctcgcccgtcaccacccaggcgacggggccccaggagctggcaaagaagaagatgtacagacagacaaacgcgatcagcaccttgttggcgacgacggacgaggcggccgtgccgacgatggccacgatcagctgcgacacgcacatgcccaccgcaccgaacagcagcagcggccgacggccccatttctcgaccatgtagagccccgggaacgtcgatgccacgttgatgatgctggtgatgagggtgatgacgaacgagttttggatccccgagttctggaagaatgatgtgccgtagtagactggtcggcaggttagcaaaaaaaaaatattgcgtcaaaagtggatgtaggactcacagatgaaattgacacccgccagctgctgcagagcttgcactccacaacccgtggcaagacgcttgcccagggttccgcgaagaatctcgatatacgacgcctggcccaggctgagttcgtactcgtggttggcctggatctccgccaactcggcggtcaaggccgggttgtccacatcgatacgacgaagacgagcgagcgacttggctgccgcctcatgcttgccccgcttgatcagaaaccgcggcgtctcgggcaggatgagcatgccgacaatgaggatgatggcccaggcaaactggacggcaatggggatgcggtagcagccggtgtcgttgcgatccttagtcgcgttgttgacaatggcggccagcagaagaccaacagtgatggccagctggtagcagccgacaatggcgcctcggatccatttgggggagctatcatcataagcctatgctgatgaatttagaaatgtcaaggaaacttacgtctcagattggtagagaggaactaacgacgtcagcatcagtgctacttacaaatatggcgttttcacttactcgtcgcagaaagcagaccgacaccgaacccagcaaagaatcgaccagccacgaacagcggaatggctgtggcggccgtctgcaaggcgacgccgaagcagaagacgaagcactcgaggatcatggagatgcgacggccaaagaaatcggcaacgggggcggcagtcagggcgccaaagaaggttcctgcagacagcagggagacaatctcggacgactgcgcagaggtcacgtcgggcaggccgtcggcgggattgatgtagccggtcgagaagagacggcgccagtatttcatggccaggatgccgctgatggtgccggtgtcatatctacgattgttaacaggacttctctgttagcaggactgactactcacccaaagagcacacctccaaaggccacaaagcagccgatgaggatggccggggcagcagacccgacggcgtcgtcgggcttcttgagcttgaagcccatagctgtatataggtggccttgttgtcttcagaaaaatagatattaagtgcctggagggagctcaatggtgtcaaaaaagtgagggcagaaaaaaaaaggagagtgtagtatcacacaaattgtaaaaccccagtccagaaacggggcccgacaggcttttgtaccagccatgtcttcacgcaaggagaagcaggccagcacctggggattcgctgggggacgctctccgcgcagtcgccccgctggagtgtgatcacgcgaatggggggagacggggaatcagaagctggagactggagtagtctagtctagtctagtctgtctctgtactctactcgtcctgcgtctgcgaatttttcagttcgtaacactgtggatcccgaagaccggcaggccacgctctgggccgttctcgatgtcgttctcgaaggtgctgtggcaaagtcattgtttcaataatacggagtagaaacagctggtgaaacgagtggagcgggcagaccatgggtgagggtggtgactgtgctgtgagctggtgattgtgattgcttgcgttcgggattccgaggcgtgaagatgccgatgattagatgagcgccgatccgatcgtcgccatcccgatcggcaatccactcggccgatagagtattaccgagtacagagtatacctgatataggagtactctgtacggggttcaaatagcgacaatagacagcaagaaatgaataaaagaaaaatcaaaaatgaattccctttaagacttgccatttaattcgctttttacctcctcgctttcagggacaagagaataaatagaagctccatccatccgagcggaaaagtcttacccatgggtcgagctagacaggcacatccttgcccgatcgagacaatggctccttagttagcagtattgattggccgcatatcccgatattacggtgggccaccgaaataccgatgtagatccgttgatttttgagtacgttcctctttttacgatacaatgacgtacacagatggagctgttatttctccagctccagtgctactcagcccaaccccaggcactgtgacaagcagaggagatagtaaaaatgacttgctgggatagttctccatcacaagggctccacgtgacgctgttttgtgagtcctgccattcccagtcttggcatcacgtgtgccaagaccaacgcctcccgatcttaacaacttgctttttaataacaaagaacagcatctactagaatacaaccttgctgaacagcttgatgtctcccagctgtactatagtcccaagacttagaagctagaggagacaagagaatacttattagagccaacacaattcatctcatgcctggccacaaactgttagttccaggcatgatctagtagagtactactactcactctctgagaccattgaccgaggagactaccttaaagagttcctcagctgacattataaccatcagcagggtaagaacatcaacagatatagaactcctagaatcaagtttaaaaaaacttattagagaccttcgagaaggtaggcatttatctagtttataagcacaaagcagggaacaacaggcttaataaaataaccatcataaaaggtcaaggatatgagcaatcggtcctgtttcatacaactgcaagcagaagaaaagaatctccttaagtattaaccaaaagtgaccctgtcaagataaaatttgcaagcagctagctataaagcaagctgaccctcttctgccgactagcaactattactagtagctatctgtaggtattgctagactgttgctatttatctctccaaatcaactatctgatatgtgatccaggcagagggtgtccttgactatttatttttttatttatttaatgaaaccaacagaagtccatcaagacgcctctgggcaagaaggagcagtgcatttataaattttccactctccccccttttttttttggctgttgacatctttgcagtgagaccatctccatatgtatgtacagtacagtactgtacagtacacggtcttgcttgtctcctcctgagtctcctgaaaaggtagctctcagtctctcttgtgcgaccttgatcctcagccccatgtcttcctcctgggcctattattctagaatatatctgtagaaggcccgattataaacgatccagcgaatttataacaatccttggcattttaaatgggcttaaccggcaggagttgcagttcaaggataaaaactattagattaatctagattccgctaggtactgtactgtattacatagtttggcaagcaggtcgggtttagattgctctagattagtaactattgtcagtcgctaaagtagggaggcaaagtcacaggctttgaacaagtcacaaagctatatggccttttttttttaaaaaaaatggagtagctaataatgttcatgaatagttcttattaatagttcttattccttttttgtcttagctagtcttactataggataggctagataattatctatggcctgcctccctagaaagcaattaatatcgttcattggagaccatatgcactgtccagaaccaactcgagctgtgcttgtccccctgatctccattattccaccaggtagtacccttcgcatagcaagacggctgcaagaggctaatcctacacatcccatgtggcctcgatgatacccagcttcgacagcggcggctggatgatgttggtgagcttgagacgcggatcggcggcctggaagagggcggcccagtcggcgatttctcgctccttgccgttctgtatctcccacatggccaggtcgaaggagctgcggtaagcgcggtgagtcagccagcgagggtaaacagatgattttattgaagggcgcgactcaccggacacgcttttcgagatacaagggaatcacgcccgggtcgggcatgatgaactcgctgaccacgatgcgggcgccccttttcagcgcggggatcaaggccctgaggatccggatgcaatacttgtccgaccagtcgtggaagatccatttgaacaggtacacgtcggcgtccttgacgggctgctcggtgaaaaacgtcgtgcgcctggaagctgagtcggtcttcgaggccctcgggcacggttgcgctggccacgacctccggaagatcctgcacgacgcagcgcaggttggggaagcgccgggccagcgagacggcgacgtcgccgtgcgagccgccgatgtcgaccagcgtcgcgccctctcccagtgcggcccagtcgtagttatcgcgcaggtgctcgggctccatgccgtcgctggcgttgaagagcgacatggcctcggcaaagcgctgcgcgcgcgccggatcgttggccagcaggttgagcatgggctggtccgtgtggtgggcgatattgaagccggtttcgttgggttcctgggagctcggccatttctgcatggcatcgaccatctgaagagagtcgactcatttagtatcttgtttcatttcaggcagaagcaggaccatacgttccctggtggcagcaggccacatctcctccgtgaccatgcccacccactggcgcataatgcggttgttggcgaagaacttggaggcgctggtgtgcgcgacgacgcccttgcgcgactcgcggaagatgtgctgggtcatggcggcgcgcacgatgcggcgcaggttgaactcgctgagcccgcaggcctgtgcaagctcttcatacgtcgcttcctcctggccttcggggaagctgttggcgatgttgaagcggtacagcgcgtggatgctcgtgagggcgttgtgctgtgttgttgtcagccgcgcgctggattcatatgcttgctgagctggagggatataagcgagggacatacagaaggcttcacgaaagcactggcaggcccggccatcaacgcgtgcagctcgtccgtggcaccgagaacctgctggcgggcgtgttcaatctccggagggtagtcgtacttgggcggcgcgtcggggtcaaaggactgcgaggggaggcctttctcggcattgtaggcgtcgattttggccgtgttggtggcaatggtcgatgctagctctgcgatgcgggtgcaagaagacatggtgatgttgttctggtgaagatgggatcgctcgagtcctgctggttagattatatgcagtctgccttgtcgagctgactcgcgaccaacgccgccagccaaccgtgctgatgctgtgcaacacgaccggccagtcttccactcgcactatctcagagggatttttgccaacagataaaacggaatcggccagttgggggaaattcccagtccagcactcgcttctctcgaaacaacttatgagacagcaccagggtatgtatgtacatatttacgtacgtaatatgccactagttcagctgaacgccacggttgcatgcatggtccctggattaattgattcccagtcgaattcagaaaagcaaggcacccgcaatgcaacagtccagaattgggaggccatgtcgatgcatacagtatcgacctacataggatactggcaaaaagaaatatcgtccactttattttcgttcgccaaagtcgttagtggccacgatggggtgcttcctgcgatttctttcccgacatatacgctatagtcgaattgcgaacctggagagcgacaacgacaacaggcccggcattattattcaattctcctggtgctccctgatcgtgaccctcgttgcgctgtcgacaatcctggtggtcacctttgctgctggaacgcaccgcgtcgcgagagcgttgtctccagactcagtcatcccaggtgaatattcaatcttatcagtaaaagagagagagagaaagagagaactgactcgcatctagtggaaaaggcccccagagttttcagatataatgcaacctttgcggagcgaccatccgtcatcaccgactctgcctgggagagtctcttccctgcccaagggggattcttcaagcatccaaccatcgccccggagagatcggcctttgctgtcttccaccagctgcactgtctggtatgtatgtccttggacgaacagcggcagaatttctattgacagctggaaaaattagaacgggattcgggagggcttctgggtcctgcacgatgccgtcatgcaaggcacgaagctcgacgagcatgatctccccatgatgtcctcgccggtgcatatccgacactgcatcgacctcctgcggcagagtctcatgtgcaacccggacttgacggtcgagacgaaggacaaggcactgggaggcgtcacgggctttggcacggagcatcagtgcaggagctgggagcagctggtcgagtggacgacacgatggcagacctacgagcaggatccaagcagagggcaagaaatccactagatatggaccgtatctgactcttattttaaaatatgactagtatctattgcactaactacaaatcattgctcaacaacgggttcttcaacctctggatctcttccacgtcgaccttccggtcctctatcgacgccacgaggccgtcaaagtcgacacaagtccgcggtggcatctgagagttgaacatgggcctggcgtctgttttgctccagacaaaagtggatctgcatggcatagactcgtttgccgtaacagatccaagcaatgatctttttaaatctcatgtctgttgacatggattaatcatgtactatcatgtaccttgaacatttatccagggtttttttttcagcgcccccacgtttggtgctactgacatagggatgtaccttccaggtttgattctcaacttgccataaccccctcctcccatgtatatatgtatgtactgtacatgtaacattacatcgacttctattccggcgactccgaatactgtcaattagccaaccagtcagttgttggatacacaattgcaatgacgaaagcctctggcagcgatagcagaaagcacaaaaaaaaaagcaagcatcagatgagtgttgtgcaaaccatgcatgtactgtagcaagcatcatgcgaagtgaatctcaacacggtcactcactctaaattccatccttcttcttcttctctctctcccttttttaagaaacctcccatatcgaaatccatagtccattgcacaccgtccgtcgactcgatttgatttgatttgatttgattccatttgctctctctatatccagtcaagatgcgtttctctgtcatcctcgttgctgctaccgtcagcgtcgctgtggcctgggcttcaccggctctgagagctcgtagtggtatgtcgactttgctcaatggctagattctagacttcacttttatctggtctgttacatacatacggaaggctgatacttacttcacagcgtctgagggtaccgtcgacgagtccaaacaaaatgttgaggactcggtcgcctatccggatctatacgaacgcagtgaggatgctgttgcctatccggatgcttactagaagaggaacgcagtggaccatgtggcataacttcttatcttgattgtgttccggcttcgtgtgattaatggagatgatgtttgctgctctggaacaagatctgtactgtactaggcattgcaagcatggctagccacaatccaccatacttttggtcctaaactcctcccattctgtggcgttggaggtacacgatttgctaagaggtgaatggtaatatagtacatacagatgctctccccatattcattccatcgatgagagcaattgatttggagaagatccaccggctgggagacgacagtgctgccttcgattgtaaccgcaggtctgagagggccttaatctttgtctacgcggacatcatggtagaaaatgttccagggcgacttcacggtcgcataggcccctggaacgagagcaatagaaggcttgcttgaacgcatgatccttccgagttccagtcgtttttccaacggagaaatccgggaggtgagtgctgttagtcattatgtctggccataaggatggtcttccttgcaatctaccccagtgatttccatgctggtgttgccttgcatttcggcccatctcagctgtgttgtcatatacagcgaccccggattgtcttcggcgaattcttcctcaagaagcctattggcattctactgcagagttcagctctgtgttaccttcaggcccagaccctgagacagtcgctcacgaaatgccgacggggaaattactccattttcataaataccgtgcctgcgaatcctggagtgtgagggtgggcagttaatctgacgaggcactggaacggcagctctcaaatgcagtcctttgaaaggatcagcaacctaacttaccttctgtgcgctctcatatagatccctggcagctgaggcgtcagccaagtatataagtaggcttcatactcaactcttccttttgaggctgcataaccaccgtcatggcgacgaccgtgctaccaggcattgatctgacagccagcaagcagccccaaatccggggcgcaattctatccacatggctcctggccgtgctcgccgtcggtcttcgattcacttccagatggctcgtcaaggctgggttctggtgggatgactggctgattctcctaggcctggtgataacccacgccgccttgccaagcgaacagaatgctgatggcaagccccattccacagattcttgcgacggctgtcgatcttgtcccggtaatttggagtgtgtccttcccagcaaacacaatagttcttggtgtgatggtcttgaaatcgaggtcctagcgagattgaactttttgtatcaagtcgacatgaaacgtacttatttgctcagcacaagacagactcagactcgctgtcaccagatatctagttactgagatgtgtttatttgatttacacagtgctgattccatcacatgtccattatttatttcatcgatccatgaagagattaattaaataattataccacgtctaaaccaaactaaatataaactaatatacaccgaatcaaaccgcaatagcaacaacgaacgaaccaccgaaacaacaatttataaaagtttattattcaattaacgaaaaagaaagaaaaagagaaagagaagaggattacaaattctcgaaatcaacacctccaaccttccccgccgtcgccgccgcatactcaatccacccgccataccgcgggaagcgatgctcctcaccggcctcgagcggctggacatcgcgcgacacgacgctgatccgcaggtgacaccggtcaaccagctcctcggggtcgatctcgttgccgtggaagtcggtgacgcgccagttcaggttgtgcgccagctgcggaacgacggcgtcgggggcgagggtgcgcgggacgatgccgtggtatagcgccgtcgccatgacgggcgagagcgagatctgcccgtagcttgtcatccgggaggaggaggatgctgggcgtcgtggcgcggtgaaggtgcggtatgtgccgatgaggttgcttgcgtggccgtattctgacgggtccaggtctggcgatgggggcccgtagaagaagtggatctggaaaggtttgccagcgagggcgtgtctggtagagaattagttagatcgtatcgtcagtttacatggagacaagatgagggcactaacttgttcacacggatattgatcgcccagtgccgggccaggttgttcacgcccagatcgaagaattcctgcgagctcagtatccccgtgaccatcgcagccgccatgtcatgaatgttgtccgcaagctgcgagggcggtggcaccaggtctcgctttgcctgcctgctgggaggcggattgtacaggttgttgacggccgcgcggacgttgttctgcagcgtctgctggtcgacgtcccagtcgacaatctcggggtagctgtatccgaatgatgcgatcgatcgcaccgacgcggatgtccagaagtcgtttgcgttgtcggaggcgtggaagggatagagggctggataggtcggttgtaagcttcatccttatgcatacaatagatttaacacacgcgtgtgtgtgtatagaaacttctgtctactcacgtgaatccacagtcgaaaccgtcccagccccagtcacaaacgtgtcgtacgcatcggccataggctcgacatacgagtcgggattgagcacctgccagatggcgaagatgcggtcgatggcacttcacaggatcagtctgaattcctctaaagccccaagttgacctgctaggccacctaccaatgatggagcatgaaaataggatcaaaagcggccatgtcaaaatacgtcatgtggccgccgtcgccggtcagcgcgtgcaccgcgtcgtggatgctctcgaggttgttgtagttctgtccacggtccttgagcacctcgttggaaaagacggtgtagttggtctcggtgctcaggagctggtacgtgctggaacggagcctgcggaagaatccgtcaatcagtctgtccagatgttgcaactattatcctacttggaggacctaccaggcggcgttggacgtcatcaactgctgaaccctgtccatcctgctctgaccgttcgcgtcaggcgagcggacggtgttggtgtagtttgcgagctgcgaaatcagcacaagatcctgttttccagtagaaactatatcgactcaccgggttatcattcgggatatctgtccccacgggcaagggatggaatttataactatacaacggattatccacctgctgctgtcccgatggcgtgttgatggtgatcgtcggagtgaccagcgcatccggcatctgggggtcgctcgcccagtcccagtagggcactcgcagcgtggtggctgcagctacgtaggtatcgcggttctcgtccggataggaggcagcaatgtcctgcgcgtagttccacagtatttgctacaagcagttagcagtgaacttcgccacagtgaaaaaggtccacgaggtatcatacttcaaacagagcaatatacggccgatgccacgtagggaacgtgactgagccatgggagcagtatcccgtctggtacgatccttcaacgccatcccaggatcgatacggaaggccatggattcctacatccatcatctcgacattagcaactgatcaagtcaaacaaaactactatcaatatatccagagagacaacaaacagacatacccgcaacttcataccaagaaagcagctccgactgatcctcctcctggaaacggatcagagcctggatgtacaaatcgaacgcgggccccgacgactggaactccttcaggttgagacgaaacggccgctctcccgtctcggggttgacgccgccggagacaccagtgacagcgacagccaggcagattcgaggcaggaaactgacgctcaacaagctgagagcgtacagacacgctcgccgaatagacagttccatggctgcgctagaggtgacgattccttcttccttccggactctgttgtgccgttgactagaaaatatatacaggatcggtcagtcaacgcgtgtgcacttaaaggagcaaagtactgttgatagtgctgttgatagtctaagatcaggccacaagcatgactctcgttagccttgttgatcacaaaagcatggtcaagggtcactttgagaaaaatatcgacaatcaggcaaataattccctttcttctgctccacaggacatgacgaacgcttctcgacgagataaacaacggtcctgcagcaatccagtccaggctatccggtaggcttggcccgatatacactgcaaccgccacgtagatcgcggtagcgaggcattctgaccaaggggcagtatgcagtgtctaattcattcgtctatccctagatgaagtggtcagcatccctagcaagattctcatgagaaacaatgatcgcccagatactcacgtagggagctagtcttgaaactgcgagtcgacgagatagtaaacaagtttcctgaaaggaggcctgtttgctgcagaattgcatcatgaagtatgcaggtacacgtatgtaccgtacctgcatgatgaatgcagtcctgttactaggccgacgtcattccaatggatcatgaaatgcttggccgactatcccgtttagctcagatagcggattcatttcgtcagcataaataatagacctcacattttgacgatctggaatccaagaaggaatgtcgatctttggagaaagggaggactaagagcaggagtcgcaacactttctcgtaggggccggccacgtgatgtgcgtgccctgaggaggtaatggatcatatacataattctaaaaaggaaggaaataatagaaataataaaaaaataataaactgctttctaccaaatgtaatcaatccctacaggccaaacctaaataattgccagtgtagacgataccgataagataacgtaatccacccccgagccggacaccacctccgaacgcgtctcctatatagaaattgaagctattcaacacgcgattatgccaccaattcgcactgaaaagtcaaaaaaattaattgagcaagagggcaggctccaacttgcaattcctgccataaataacggccaaatttcttcaattcgtgaagctgttgatttgtttgatgtcccgcgttctactctctccgacaggcttcatgggcgtagtgcaagagtcaataaacgtgcaaattctcataaattgaccgaaaatgaagaggaaacgcttgtcaagtggattctggacctagataagcgtggggagagatcaagacagaagaatacagtgattcttaggctttatttccattccttctccctccaataagctttggctcgtagccaacagtactgtgaaagatcacattaagcataccagtaagagccacagctgtatgtagaagctgtagcatgtgagttcattgggaaccactatcctgtagacaaatggacctttctgatcccaggctagcgtaaacacccatgtgctgtcgtatttagcactgatgtaatgccattttacatattgacttttcgaaggtttgtaactcacgggtcctacattgtttgacttaacagtcatgctggtcttccgcgaaccaagaacgtatccatgttctatgtagtgggctggagaagtctagattcagcaagttcatcattcgtcttcatcgcgatcattgaagggccagtttttttcaatctgcgccctaatatcttccgactcagcactggcaattgcttcggctttgagcctttcattcagctctttagaattgtcgtatctttccgtactgacccatccatcaacagtaacccctaagtaacttcgggatctttccatgtcttcatcagcttctctctgttctgcctcaagctctaaacacttctcaacttcctccgaagagtagttcagaggacagctataacatttcacatcccccatggacgcaatttctcgccaacgccaagttgcgcggatcagatctgctttcaaggatatgttgtctccttcccagggactccctgcgtgttggaagagcttttgttttaagacaacctgctcatcagtgcaggcgtcgaagtgctccttgttaaatttagctgtcattgcgaagtagtaatagtgaagctgccgtcgacggaaaagttccagtgcagcttcttgctctttctcgttgagctgtgcaaaattttgaggaagctgtggggtaacaagattttccgattcctcatctccatagttctgaaagtatctcggtggtcctgcttgaaggagaaggggaagtacagaacagtgctgccagtctattaatccgacaatttcaagggagtctgaaacaaagatattatttggctggagatcaggatggcgtatggttgggcggttcagattgcttccagccttcggggccaaaaagtccgcaatttgcaggtagtctgaaaggttcttgatgtgatctgccgggtctactttttggttgttgtagatctccctatataggggttcaaaaggaaaacgaggtcgtgcatacttttcgtccatgccaattctcgtttcgcaactgcccgtagaacatctctggtggatgagacttcacgcgcattattaggtgctaagacaaaaaaaacaacccactaggcgacttacatggacccctttctactgataacgacgctcgctctttatgccaccacctgtagtgcgcatctgggccaatgcagaatttcccgaaaggtccatctactttgatatcaatgttcctggtttcatcagcaaggtcatgcttatagtatatgcttccacttgctggaagttgaacagagaaaagtaatgcctccaatttgacaacttggacgatcattttcagtcgttctttttcagacatcgtataccagatgttgcctagttccttgccaacgactttttccataattatgtattcggcaccgacagggttctcatttgtggcagagtaatcaaacacacgcgggactggaagtccatgtgatctcacaaaatccattgttgcgacttcacttgctatcgtgtaatgagttggtgttgtagatggataggggagtcgcgcgatgacttggaatccatctcgcatggagatctcaaaggtgcgattgaaaccaccttccgcgagctttctgatagataacacatcggactctgaacggttaatggatttcgcagctatgcgttttagctggggcacatcgaaaaccagttcccgttccgcaaggcgaaggggctcattgtagcttcagttatttcattagtgatgccttgtagttcgagtaactaagactcacatccatctgcctgaggtataccggaatagatcgtgagcgtcacccatttgcacgagaggcgccacaggcgaggaatgaaaccgggaaatagattcggtcttgcagattcgcggcgttggacagattatgtgcttttgagtgtatcgaagtggaaatcttctatccataggccccggtattctcttctcattttggtctgaactattcaattgttagcaatattatttggaggagtctagtgagggcattagacaatcagaccctttgcaggaaacaaacgggaggataggaacctggagcctttagagagaggtcaaacttggcgatggcaaaacatcaaacctatcgcccttggacgaagaaccatgtttaatgctgaaaatggcccctcgaagtggtgacgtggcaagctaggcagcaacagcaccctggagattccagggtgatgtgagtggacagattctgaattcggcaaggtcaggtttgtgcaatctagcgtcttggccaagactcctggagaaaattgaagctgaaactcccagcagacagatcagccaatgtcaagaacctgttctctctatgagtcatgacatcaatcttcaaaagagcgctgaaaggggcgtcgttgagaaagctattgaaggaaacacttggaaaaaattttccaatccaactgctagtcgaggtaatacggtgtggcccaagagtcagaacgaccaggaaagcatcggcattcgtttcgattatgacggcgaagtttcccattcagatggtgtataccataaattccagattcaacccaatgctggaaagattccttctactttcaaggattggcgagataaccatggagggactcatgccgttatggcttcggcctttgtgaagaaagacggcacaaaagaagacgtgcggagcggattggaacgcgctgcagatgccattgttggtggcttggattcggacgactaagagagtggtaacataagaataattgatgttttcctgtttcattcccgatgccaggacttggcagtaaaggtctcgtgactcaacgtgacccgcggagtgggtccaggttgcgatgcctgtttaatttattaggcggcatcgttcgctttcaccttgcccttattttattattgtcctgttgattgcgctcgggcatatggcaagctgccagatagccccgtcagcttacttgggagagaaaaatgttcttcttggaggcaagttccaccaaagattcgacggcagtttttctgtcgaaaatcgtgcactcttttactttccaagaatatagttggtcccctgcaaacatgcaagacactccagcaatggttgtgggagccactggaggaattcacaactgtcaggccttgggaagttattatcgcaccatatacgcaggggcaaaccattctccgaaaggatgagctcctggtgagactaaaggaaagagacaatctgtcatggcgtgagattgcaaagcacttctcaggcagaacgagggagtctctccaggttcgctactgcaccacactgaagcactagatgccaaagtgtcggggaatgaagcggaaacctaaagcgtactctatgtctgctgaggccacttcttccagcgggttgccacgtgatttggatcctacgttgcatactgcggacggcaggcaggagctcccaaacctactgacagcatcgccgtgccgacaacgataccgcccgcctcgatccagacgtgcagtagacctctatggatatccagcaggataaatacatatcttcaatcatgactggatgagatgcataaaatggcgtggaaatttctcttattgaaaggagagagatcagagggctcaagagcaaaagggcaataaaaggatcaatgtatagaatacttttcaaggtgtatgaatatcaagctgaatgtgaagcagaggttatctggccgtttgtttccggagaagggtaagaattacatgttcaactcggatttgatggaagaatggtttatgcatgaggaatgcctagtatatgccctcttctcctatttctcggttcatcgatctcttaacatggaaggagaagcactatccaatccatcttgacggcgtgcaaagactttgacgataagaacgaaaagttaatcagtgacgaacacagctcctatcattctcccgcccaagcagtgaaatgaacagaaggataactttaccttacatggcgtccatcgatacgaagtccaagctacaaaacttagtcctagtatcatgcagtcagaggaacacaggaggcgtactcacatcgagggcgtcgaacccaggaaatcacttctttacgggaaagtggacgctctttccctcgcctttcgagttaaagcagactccagtgaaatggtctcttgagtcgctagggccggggtggtcgggctctctattatcgcgatcagtttcagaaagtgaatggctcaaggtccacaaccttgcacagatctctcgtgtatcctccggcgaatctcctgtgtaaccttccacggcctgggcgaaggagtccttcatcgcatcaacagcgatctcaggacgcatccagtgtgtagtccgtgtggctgcggaaagcgtgattagttgaccattcttgacgatcgttccaatggttttcttcgcgatgatcattgtaagacatcgtgtgtagacgagtaatcaccgctaagaggcaaagttgaacccaaaattgaatagcagagttgattcctattaaggcagcggcaaaaaaaagctgctttcgaatctgaatgtattaagaaaagaaacgtccttagctttataagctttcatccccagcagaaccaatctgcaaaacaacctggactaacaacgaaaagaacgccacggaacgtagaaagccaggaagtagtctcgcttgtccagcgtggaacagcctcttaaaaggcccagactagccaacttggaggaagaatgaaacactcacctcctgtgcagctgtgccaactcaccttaagtgcgtcttgactcaatcagaagccagcgcaagcgctgatagtgtgaaaatactcaaggaagatgcagtttctgcgcctccatgactcatctcatgttgaaacaatgcaagtcatatgacaggcgctaccctgaacgtcttgactagtgcaataaatgcaggaggaggtgatgtttcaagtcagcatcaaacctgtcctcttgagtggttgcctggtctcgcactaaagcaccgcatataaaaaagactaggaactgtttttcggagtaactgtcattccgaggtcacactcctttactacgcaaactggagttagggacattagtgatattgagctttctacttgtgagcaactgcatgtggtaactgcctcaaaccaacaactgaatgattcgtctgcgttaaacgtgcatatccttagcactcctgtcctatgtttgacaagcatgcctcttagcaaattaattggaggtctctggatatgatgctggctatcagtagaacgctttcatactaattgacaggttcgctgatccatgtacatgagggcatgtcgtttgaattgcttttcagaagaattaaacataaaagtacagtccgtttccatcatgttgtcccagctctatcccgtcccatttcttcttgattccctaatcactagaattcctctctcattgcttctttaaataccagttggtcaattctcccatttagtcaaacatataatagcaatggcgttccgtctgtccaaagctgaccagacaccatttgatactccagttagggtggtattctggtgctgtctaccataaggaatagctaaccgtatggcgtgggtagccataagggttcgttaactgtatggtagaccacaattttcagaaatactgcaaaccctgtggtatagtttgttctatgatatgggcaaccgtagggggcggctggccacatagtacaccacaattttcttaaaaatactgcaaactatatggtatagttcaccatgcgggatagttaaccatatagtaggccataagtatggataaaacatggcaaaccatgtgatcctgtccaccataagggatagctaaccatctggcgtaggtaaccataagggttcgttgactgtactggtacgacctacgattttttagtaaaaacgtagcaaaccatgtggtattactttgccctatggtgtgggcaaccataggaggctgctgaccatacagtagaccataatttaataaaaatatagcaaaccatatggtaaaactcaccatatatgatagttaaccacatggtatgccatatcatggtagaaaagtgctcaatcctatggtgtgggtaaccataagtagttggtaaccgtatggtagaccacagttttaatagcatgggcatgattgtgatagagcagtcagcaaaacgtggtaccttagggtgaggcattccctaaggtttggattcccctctggttgacgtcattaagaaatcgcctaaggctgaagagagtcccttaaagtaccctactctgtataaagaccactcaagcaagagcccaagcgccctctgttggcaggtctctcattggctcttttcaagtcacctttgcaaaatgcccgttgggacccgcagcgatccttaacaagtaaaacactgccagggtgtgcttgggccattgcattgtcgaaaccctctacttctagctcagtaccttgactggtcagaccccggcacataacaactgccacgtcacctgcctgtttataaatgcagcaccagggtcaaccacaattccacagcacgaggaatgccgaggatacacttcagaacatagcagattttccagaaggtggaaacattgctgaaagttcagaggtgtccctcaatcagctggccgaaagtcaggctgaggcataccaggtttccgatcctcttttcttccatatgtggatgtatgcccttgctgaccgcccactcattgacgggataaaagtccttgcaaagagatactttcatgagacatttctgcatcggctggactatggttctttctgccgcgcagttgaagaagtatattgttcaacaccgcctgatgaacggggactgcgggacttggtggtcaacgtcaccctggatcacttgacaacactgagaaactcgagagccctatctgactatctcttgaagcagatacctgactttgcacgtgatctttgcatcgcaatgataaacaaaagtgttccgccgccatccctctggtttttaacccgtcaaccaagcttcaagttttagcattgcatattctcacatctttttcagcagtttctgggcctcatataaatagccctagccaagtgagtactagcgatcgagtttagctcattacctcataattggtcctcgatctaattgtgcaccccacatacctgaccttcttttgaccaggtgttccttgaattcaggtcttaagcaattctttggttaaacagatcaaatgcaagatagcacgtctctgcagatggttcttctatatcaatgcagaatgtggcacagatgttgtcccacctgattagtttgtcatcgcaataaccaatcctagttcgaatcaagtccccggaggcctggcaaagtaggaggtgatctctctcatctcgcgcttcatcgccttgtacattcacaaccgcgtgtgaggtcttctatattcaccgctgcactagcccgtgtgggcatgacctcgacaacctgactgcctccacttcctcttcttcctccatttcttctttctcttctcccttcaaccacgcttcgctgcagaactggtaggtctcttcccttccccagctatctctgacgcttctctcaagtctctctgctgatatggatgctctatcgccatcaactgcctgagaattgactgctcttgacatcgctcttcatatcgtcctcgcgtgtgctaccccttgtgggttaacagacaacccatctcccactcctctctgaactggtaggtcccctcccttccctggccatcctctgtgcttccacctagtctggttactgatctggggtgatttgtcgctccagccttcttctctccttctctctccaccttacagcaacctcgtggtaagcgatcttcttctctcaccgtctctcacacagtggccctgtgcaagaccccagcagtcttccgcctaacctatgacgaaccctctcctcttatccccttggcaggaccatgtcattgctgaatttctgaggctggtaggagcatgtctacacccactggttcccgcggtactgttgctgccggctcctcctccttcttcgcgcgtcgccgtgagcagcaggccgctattgaccagcagcgcgagcagcagcttaatgtgaccgctgctgaggaatgccgtctgcgtcggctgatgcagcagcacccacccaggacgccggaccatggtgtgttcgtgcttcaagccgacgggcgagccggaggtaggccaactttcccacccctccttccctctcccctctttataagggcactctgctgaccggggccttagagatcttagtaactcaggttaaatggattgaattgagcgcgagtaaggagagactagatacatgagattgagccttcttttataacttctgttttggtcctccatctccttccttccgtcggtccctgttggaccttcttctcgtggtccatactggacctcccttccacggtccttgttggactcctctgcttatcttatcaatggaccttcctaagtcacgtgaccttgtatgcctaatcctgtcaatcttgcggggtagtgtttcatcctgtgttgctgtgttggacagcgcttcgttctgttggttcgtaacagctaacccatcgggactagaaacttcatctacaattgtgctttgctgacactgtttctacatgttaatggcaggagcgacagtcgagccaccagccttgaaccactgcctatccttcaaatgagcctcatccttgatttcgtgcaagataccagttagtgcattgaggctgtggaattagcaggcaccagattttattgcaaaaatattgaccacatcctcgatttgcaaggcagacatccatgacctcctccaaccctacatccgctatccgaaagtggtggtatcagtacatccaggtgtcgatcgacaacgtctgcctgctcggtgttcatgctagtatgcaatttggagcaaacactggtcaaagatgtagcagagaatcgaaactatggcggtggaagtgctggcacacgcctgcaaatttactgggaaacactattaactacaatagtctcctggttttgaactgccatacattagtcgaggtttgtttggtcttaagcgacggcacgttcagctagaaggtaggcgtggaaattaacccggggtatgcaatacctgccaccccgacttcccaccatacagtctcttttttccacggtgccttagatatttgcatctgtttgacagtgccagagatcgggttcggagaattccttattttaaaatcaatcccagcttggtaagtcgaggctgctgatggtgtctggtgtcacattcgggatcgattaataccgaccacgggcatgggatgcattcccatctcttcgtcctcatcgtacgttgtcaataagttatgacgcataaatcttagcatactatatatgttactaggtcttggacgatgtggaagtcgcgaactacactgggcaatgttgtgtcaggtgcaaagcttactgcggatggcggacattcaccagactcgctgaagagctctgtagtcagcgagaagcagactgcctctaagggcagagaggatgtgcaggagatccaaccatcgaaccgatgggatcccaacctgtcttcggagaacgaggacatccttgtcggaccttcacaggcctcagaggaagaggccaaaattgaggtgaacacatcattgtcctcggaaaattctccctatgagaccgttcaggcagctgttcggaacacggacggggacgaggtcgccaatactgttcgcgcctggatcttggggatgttcttcgtgacgattgccagcgggttgaatatgtacctgagcatgaggtacgatcatccacatcgctatttgttacttctgccaagcatcaaacagccattggtctgacgatccacaggagtccagcaatagccatttcgtccgtcgtaattcaattgtaagctcggtatattcaatcgttatgagagatgattgctgatgaattccaagactggtgtttccaatcggttgcttttgggcaaaagtggttcccaagcgggtgttcaacacatttggaattcaaatggagctttaacactggtccgtttaccatcaaggaacatacagtaattatagtacgtgtacaaacaatgaacgttttgcaaagtaatacgcgagtactaactgatctgacagctgatggccaagtaagtccacagttccgaacactgctcgtgtcttatctggataaatctctgaaacaactcaaaacagtgtctccatctcatacgcttacagtactgacgcgctgattgccctgaaagcaaagcgtgcgtcactatatctgcgaactgggtgtgcctgaatgctgacctccattagcctattataatgtagacatgggatgggaatttcagttactcttcactctaagcagtcagctcactggaattggtctagcaggcttgtttcgtcgcttcttggtctggtcagtattgtctcgggcttccacgatgaatccgcaacatcattactgaccttcgtcgataggccatcggcaatgatctggccgagccaattctcgaatacctctttactgtatgctcttcacgacagaagtgcttcggactcgtcccagaccaatggctggcggatctctcgcttccggtatttcttatacgttgcgcttggatcttttgcatactactggtacgttcacgctcgcacccctttggaatgagaaggcctcgactgattttaatgctaggatccccggtgtcttgtggcagggactctctatcttcagcttcatcacctgtaagcatgtccagggtcgaattttacgcaatatttcatgcaactaaggcatgtgtcagggattaagcctaatagtatcgtgctaaatcaattatttgggggatttaccggattgtccttgcttccgatcatctttgattggacgtatgtctcagctccggtatttctttcgaccagtataggcgctgctaacatgtctccagctatatctcaaattacctgaacgatccattgttggctccagtacacgcgcttgtgaatacgatgatcgggttgatcgtcttcgtcataatcccagcaattggtatcgtatactccggagctttgtcagtttctctccgttcaccagctttttttttgggggcgaaactgacgacaactgaataggtggtcggattatctgcctgtaaacacatcgaccacatatgacaacacgcagaagacctacaatgtatccaggatcctcggtccgaacttcacgttcgacctcgagaaatacaagaaatactccccgatgttcttggcaccgacattcgctttgaactacgggctggggtttgccgcactcatggcctccattgttcacgtctcactctcccatggcaaagaggtctggaaccgatggaaaaatggcaagaacgacgccccagatatccacatgaaattaatgctaaaatatagggaatgcccacaatggtggtacggtgctctctttgttatctctatggctttgggattgtctgcggtcctggggtatccgtcgcagcttccttgtgagtattccttgaccagagttgtctttagaacttcacaagaagacattgcacgtaacaccaatacagggtggggattctttgtttccattatcattgcattgatcttcattggatgtacctcggaactatctgaaaaacgtcggctggacagaatccagatccctacttgcatgattctggcgattacaaatattactctctgtatagaccctctccaattcacgaaatgattagcatctattttctaaccccttttcccccgcagcattgaatgtcttgtctcctttcctcggcggactcatgattcctgggaggccaattgctatcatggttttcaaggtttacagcactatcgtactggggcaagcgtgagctttctctgttactccacccaaaccgtggtcaggctaacagataatcctagccaaacttacactggtgacatgaaggtcagtcctgtgttattgtactcattcggaacttactgaggtaccgtgtcttttagcttgctcactacatgaaaattccacctcgcacagtcttttcgtgccaattggttgccaccatttgggctgcctttgtccaaatcgcggttatgaattggactcttgatcatatcaatcaagtttgcacaccgtacgtttcgacgttctaaccatctctgctatcatgaagtcaaactcatcgtcatcaccggtgtcaagggaccagccagctcattttaactgtcctaacggaaagaccttgttttcgaatagtatcacctggggtacgctcacagcgcaaccggtttgaagtgccggctaatcgcgaaataggtgtcatcggtccgaatcgcatgcttggttcagactcgatatatggacattttcaatggttctggctcgtcggagcaggactgccagtcattttctacatcttggcacgaatgttccccaagtctcctatacgaatgttgaacgctccagtgtacgtggaagattgctatcactattaacttgtctactaaacaactaacaataaatacagcatgctgggagccatgagctggctgccaccgtacgtgacggtttcaattgtctttgtctgttacgatgatccacgaactaaccaaagctcttcagagccaccccgctgaactttgcggcctgggtgattgttggcctaatcttcaactactggatccggcgtcgttggtccggatggtggcaccaatacaattatcttaccgcagcaggtctggattcggggttgattctatcaaccatcgtcatcttccttgctatcacgctccccaatgtgactgttcctcagtggttgggaaacaccgcgcaattcgcaacggctgtcagtataaggtcctacagagaagtacttatgtcgagtttcgctgacacagtaaaacgataggattacttaggcacggctatacggaagacagttgcagagggagaaacgtttgggccatctacctggtagttcgagtaaacaacgacgtcttgacggtgttcaaggactatcacctagttaaaacgatcggccgaagcaatttgatgatatggacggcagtgtgattcgatgtgtcctcgcgttggggaatggagatatgtcatgagaagcagtagtatgtagtacgagcgaatttagcgtcacaatttgcttcgagatgacgtatccgtacttgcagagcattcttcctttcattcgtatggcttttccagacaagagccatataagtacatacaaatccgtgacacaaaggggattctaacggactatttaccagtaaagcttttgtaattagttgctacgaaggttgctttgaacagatttgaaccgatatcatgagcacctgcagaatggactgtatgactaatatattactaagccgcagtggtcgatgcggggaaaacctccgaaccccgcctccgtgaaggctggatggctgatttaaatgctcacctaaacccgtgggctgttctgaccatttcgacgcgaaccaaagcctgtggcagcgctataagagaactatgttcgaatccctgaagcaatctgtgctctctaagggcgacaagggcgattctgtcgtcgccctccatggcgatcccgtatccatgtctccagtcggaggcggcacctatccccgcgccaactatctacaggatggctcaataatcggcgcatatacggccttcgaacatggctacagtattatcaccctcgtccgctccaccgacggtggtgcgacttggtcccctctgggaaccgcagccagagctttaacaagcgagaatgacttggataatccgtacccgctgcagctccccagcggacgtgtcctcgttgcatttcgaaatcattcaaaggatccctctaccggacgctacacattttaccggattaccatctgctactccgatgataatggagcaacatggaaatatctgagcacgcctgcatctgaccccggtggacccaatggaaactgggagccgttcctacgaaacgcggctgatgggacattgcagttatactactcacgtgaaaatagcccgatggatcaagataacctgatgcgcacttcgacagacgggggcgtcacctggtcgtctgccaccgtcatctccggagccgaattacatgatgctcgggacggaatggtaggtgtcactgagacgaacgacggtcatctcctggctgtcttcgaaacaggccaaaatggccgcttcacgatcaactctgtccgcagcaccgacgggggtagaacgtggggtaaccgagcgagagtatatactcctacgggattacacaataatgcaggcgcgccccagatcgtcaatgtagggggcaggctatatgtgagcttcatgactgacgaggatagccatggatatacctggcccagaggtgcagctgccaaattggttgtcagcgatgacaatgggcatacatggggaggcaagataaaggtcagggacatccacagtaactggcccggactgctggctctggactcgagatctttcttgtgtatgtacgacaacggtggcgttgtggctcaaaagctggtgcactagtcaaaaactcttaaacgagaaataagaaacaatagagatactcttttttggaatcaagcttttcctttccggcagtaccttcaatacatcccgagagtagtgacgtcctagttcccaaataccttaatccgagagatcatacaccacgcagccctgcattgttaacataaatggcctatctatccatactgagttaacatccatcaaggagcgtcgcctcattgattctcaacgagtttgatctgaacattaaatgaggatgccccaggcatccggcagatgcatgtctcagctcgcttaggcctcaccacctttgtaggcgcctgtaagtagtttgcagactgcaggccttcttagagaatccaagccactttctcctgcaaatcctctcatcatttaactcgacgcaaaacgacgccaataaatacatcgagctatatttgcagcgatagcagccccgcctgtcccgattcccgtcgcttagggggagagaggtaaatcagaccgtggaagctcaggtggagagggggaagtactacgtcatgttcgttgcaatggtggaacaattcatagcatttttcatgagagcgtgtaattggatgtctgggcgcgctcgagggaaatctagcagctcatgaaattcgattcagcaatgtgctatatggtcgttctgtatagagggtaagagcatatcggatatagattttgtagactttgatgtactgtactgtacatgacagatatattgcagaaaactggtttctttcgtcggaaatttgggggaaacaagtcgcaacaagcgaacaatacgaatatatattttgacccacaacggtctaattctctacctagacttcctttcgtcttcctttcgcctttgtacgaccatcaaacaaaattaaccaccggagagtgaatatatattccttaccctgaacaccattcttgctgccaccaatacagatgaaaaattcatgcctgatgatcttacgggttcatggcactcctagttccgtcaccaaaactcccggcgaaatccatatccatcatcatccagctgcagtcatcgcgaacgttgtctgggagccagcgcaggggagtctcgacggcggagccagcattattcgcctgcatgtttgggatggcgtttgatgaggcaaaaggatgtagagtagacaggagctgcatctggtcatgctgaagaggcatatccattagattgctgccattcatgctgtgtaaaaaggacatatcatctgatcggacttggtggaaatcgaatgacgtggggttttgtggtgcttggccagacacaatcgagtcaggcggagttggcatcgactggggaggagcagctccatgttggtttctgttcaggctggaagaacgatatccttcgttgtctgcgttcccctcctggccagacccgttctttcggacaagctgttgaatgatctccacgcatcgcattgtggaaggtgtgctgcgggcgttccgcaggacctccatattgaacgccaatctggcacttgctgtctctgctttttcgcccttgctctctttcaggtccaaaatattaatagtggcgccgacaaagacggtgtacgtctccagataggtgagagctcggaacccaaagcgcttcacatgtagcgtcataagtccgtcaatcatctccgctgctttcgtcgccagcgttcgagctttggctgtctttggacggtatggacgacatagtaaaatgatggtcgcatgatagagcagattcaaaaggagaatgtgaagcggcggacaaggtacagtacgcgaatctgcgttgatataaagatgtgacggaagctccttggcccagttctccaacttctcgatcgtacgatccaggtagccggagagattgttctgccccgcgtgaggtctggaatacagagtatccaagatgtcatcgatcataatgcacagcttgcagtaagcggagaatcgactgttcgtccgagacaattgggagacaccaacatccgacgaagaggactcgaagagtttgggtttccacagttcgttttccgcttcttcgccatccagccaggtatctggggatggcacaggcataatgtcgtggattgtgggcgcacgcccaaggcagagactcatggtcttatcccacgtgtagcagctccagaagatttgctgacgtagggcgagttcctcgtccgagaactggcccacaaggtggctgagcgatctggggtggatgtggattccaagatcacgcatcattcggaatgccatcccggagtagagccacccctgagaggttctcccagaagcgcattcccgggcggataagaccagcagaccttgcagagttggaatggaggaccctttatcgatctcctccgcgaggcagccaagtgcctttttggcgaaatattcgctgagctgcgatgcatctggtcggtcggaaaaccgggctgcttgtgcaaggacgctattcaacagaaatacagtcacgtatggcccggaattggcaagatcgcctgaaattgttagcctttcacaggcagcctatgtcgtcgtatgaactcacgcataaagagtttacgacagagcaccagatggagatgatgtggccaacaccaatacacgtccagaagttcgttgaccagctcctgggagatttgcgagttgataatggaccccagttctgactgctgactcagagctggagaaggagcggcaagactgtagatgctttctttgcgagtggccgggccataaggtctggtttccacgacgatttctgacccacttggacgacgagtcaacgtgatctgttctggctgaagatgatacagactcgtccttccatagaagcagatgcggccgtcttcgccgacggaagtctcattgagaagctcggtcacctcgtcttcggtcgagacttccgatcgaggactctccttctgttgacgggtattgaggtttgatgccctgggaggctttgacgatgcagtcgcctccttgctaaaatgctcgtccagcaacctgaggcgctcctccgggcttgccgtccgtaagcgctcgagtatcgtctcgaacatcttcagacgatcctgcagggctagagcgtatgtgacagaaggcgctctgaatattgggatcaatcagctgcctctctttggtcgccaggtcaactcacttgtcaaagtaacaggtctcgttgttggcgagacagcgatcgcagctgggcagattgccgttgcagcgggccttgcgcctcctgcagttggcgcacgcgaagccatatttgcgcgtctgctggcggtcgcgtcgagggcgctgagggcgatcgctgccttctttcgtggagctgctggttgcgtctgacgtggttgccatggagcagatatggaccgtgttctcatcccatcttgtatgatatgatgacgttgagtcgactggttctggagtcagagccgcagaatgtttgtccaacggtccttggctagttcccctactgctttgactgtcgaaattggcgctactgcgctttaaatggcctgccaagcaatcaatgctgatcttgcccggcaccgccaaataaacaggagcaacagtcagacaatttagacaggaaacgccaattcgaaatattccgctgtcgtgttccccacgcgggggatttccccagatccgaggcagcaattcaccccggatttacctggcaaggcactatgctacgtctccagcatctccgacaatacggtctggagacaatctttccgtgaaattctagtccaggtcgctgcttttgctgcttccgatgctagaagtattaagatcgttgccaatcttgccaagacagaattataatccgggctgactacggaataataaaaatgagtcgggtgtctcaaacgaaaaaaaaagtccatagactgcagatgttttccccatacaccttgcagacatccttgcaagcagggataaaagacagggatcttctgcgttgaccaactcaaaccaaggatagctgtcattccaccaatagcggagaaaaggaggccgggcacctttatgcatggttagaaaagtggtacgccctcttcttcatcagatataaacagagacgtcttcgtcaaccccacgtgaagagttggttctctcacggatccatgtatccccgacggaagtcgtatgggttacatacactgcattgagtatgcagaaggagttcaaataggaaattcttcagagcaccatggagttgattcgtggagcagcgcccataaataatggcgatccctgcaagtgacgtggagggagaccggcaactctccggacggcggcatctctccgtgtcgctgcggggatgcctttgcgataatggctgaaacgtaaaactgctactcgtggagtcgattactttacattgtgcgattctagccttttgcgagtgattctattggcattgtattccatcctattgtaatttattagttggtgtaattggtactattgatattattcagagtttctgggcgcaatggccgacaacaaaatcgatcaggcagtgaactggcttcttccaatctactcgcagtcctccgagctgaatgtctccagtttgaacgcgactctgaggaaaagtctgcgtatgttggctgacaagtttagactaagcttcaaggtatgttaatgtgagtcatggccgtaatcgttataatttcagcgagctgaactgaatcagcaagatgacgtcggcaatatctacattaccggtgcaggtcgtgatccagaattgtcacccttaggcgtatgcttccctctggacgggtcgacgtttcctggtgcgttcgagggtgcactgcgcacattcctcgcgttgcagaatcgcagcttcagttgcggtatttctttgatcggatggtcgtctccggcaggaaagtcattgggtcatgatgtgtgggagggccggatatctctagaagagagcttatcacaggctccggatctcaagcaattttcgagcatggacagcttctcttcgtttggcatgtccgccttgtttgagattgtcgtgacacaggaagctactattagcattcgtggcggcccgattctcgtgcagaaagcagctaatgctgcccaaaggcccgtcaagacgcagtctgaaggccagactccgcgaagagcgccagaggtgaaaattgagggacgtgaagctgtatcggtggggagagccacggtggagctgtacagtaaatacatagcggcgctcttcgacaacttcgactaattttgctctgctgtaaaagataggagaatcagtcactaataatcatgcatgaacctttttatctttgaatggcattttcccctttcgtcggctggggctcagccttagggcaagcacattctgcctaaaatttaattttttgatcagccgcggaccccgccttcaccctagagcatattgtttagacgtaaacggtcatagaggggcatctgtatcaatcaacaaacattgggtacacaaaatgtcttcaccatccggtgcggagagtctccgcgcgaacccctcgggacagtttccctcgattgcgatgagtcgagcagcgtgtgacgcagattaatcgagtcaatgtgtgatgacgtttgttccaatgttgatccattgaaaagtttctgatatatatagataggcggtccgttcgtgtgaatactttcccaagcatgcagaattcttttctcatcgagctttaacatccccgtcgacagaatcatggcatcttcagtgaatgcccgtggcggcatccagtctgcgtctagtacgctcttctttgagcaagaaggcaacaaggacggacctgcaatcctgtgtatccacggtctgggaggcaccaccaacttctaccaaccggtagcctctgcgcttcaggattacaacctcattcggtttgacctcagcggccatgggagaagtagccctccggcggggaagacgagcatcgagtcctacgtggaagattgtgaaggttagtactgctggtatccacgagcaatctgtacgtacaggaaaagtcctactgacatgctattagcggtgatcaagcatttccacgtcaaagaccttaccgtggctggccactctctgggcggtctcattgctctccacctggccgcgaaacgccccgaattggtcagacggctcgttctgttcggtccggtgaagacgccgcctgaggctggccagaacggattaaaggcgcgcgcgaaaacagcccgcgagggaggaatgggggccgtcgcagacacagtcatcagcggatcactgtcccccaccaccctccagtccagacctgaagtcgtcggattcgcgcgggagttgctgtcccgacagcagcctgaagggtatgcgctggcctgcgaggctcttgccaacagctcggacccggagtgggacaaaatcaaggccgaagtcctcattgtcggcggtgcggacaacaaagtaagcgcagcgccgactcgcgaggccattgctgccagtttgaaggaggcgaagaaggtcgagcaagtgacgtgggagaacgttggtcattggcttgtattagagaatccgaagggaagtgcagaggtgttgaaggcgtagttgagtagaaagcgttcaagtagcgtagagaggttatagaataagaagttatccaattccttccacaaagagatttcggcaactttttcgagacaacgaaaagacaaaatcataatcatatcgacgctgccagaatttgtgctgaagatactgaaatcctcattttcttcttggtactctctactatagcctttgatgtttagctagtcaaactaggcttccgaatcctggtcatatagttcgtcttatttatcttcatcgacatgttgtcattgttcgtctatatctaaatcccctacatacactcaggcattaattattatcgaggtctaagcactatttgcgacggtggatccgtttgatgctgtttcgtctttcttcaacgtaaagtcctctcctttaaatgggctcagacccgcggtcaccctcatgccagctgagcaggcactccagtcgagaccctcacccccaatcgccttggccgtggtcagatggttccaggccagatcgatgatgggcgttggtgttgatgtctctgctcccagccgtcgaatatacgacgcatccttcatgcctccaggcagcgtgaagcccgttttgccgctaaaggcgccatcgcgaatcttcttgccgtagttcacccacgctggagcagggaaccattgttctgagagccgttagtagggaacgtaacatatacttcggaagatagaatcgtacgtatgaacttatagaacaagtttgcatcaaatccggttttctccgccagcgcgaaactctcggagagaagctcgatcgtgcctaagatgcagttgtttcccaggatcttcaagagagctcctttggatgtcttatcgccgcagtcgagcacacccttgccaagcgctgggacaagatactcttttacgacttctcgaaccgcactgtctcccgacactgcaatcaacagccctgcagatttggcgactgcaggcggcccaaagaccggacaagagaggaagtgtactccattctggcgtgcttcttcttgcaatgtctccgtcgtcgtgggaaagagggtggaatggtcgacgtatatagcgccctgcttttgctggcaaagagctgtctatacacggacagcgcaacgtcgtcgttcgcgagacagccgtgtacgatcgtacacgacgaaccgatctcgtccagagaatccgcaacctggcagtggccttgcgccaaactctccgacttcgctcgtgtccgattccatactcgaacctttggcagctgctgcgcctgagcataggacgaaagattgaaggccatgtgaatccccatgttgcccaagcccacaaagccaaacacacgcgacgaactttctgaagccatattcaatagagatgatcaagaagagtttccacagctaaactagacggctggagtgattgcagagaaactgctggccattgtcatttgaggcagcgggctctgaattctatatatgaaattggaatccccactacgacgacttgttgtcatcttcgttctgcttcgtatcgtgtctgtggctggcgtacgtatcagtgtccaccagagaagccgattctacacaagacacactttctctccttggcgattgctccggcatctctccggcggcaagtctccagtcgctctgcaagtaaccaccatccacaccaagcacggagtaatacgcgtttctacccgtttagtgccccgaggatctagaatattcaggcatggagttgccaaaaattcaggtctgcaaggatgtatgtactctgtccagcggtctgtctccgcagacgacttaccccgcttccgtgaagattgtggatgacagcaagtatttggacacgttcctcacaggagatagcataaaagcaatgagctggtcttgatgcagtgggtcttcttccttcaaatgttgttgttgtgagcatttctttcgcgtgatcaaggtcctgcctgtacagtacatacctgtcttattccatcaccatggcttctgcaaacggtcatgccagcacaacaaacggggtcgggcactacaagccaattcccgcagacattgagatagataaccgcaaaccagacgatcccgccaagatactgttcaagaatgtcaacatcattgattccactggcaaggacccgtacctcggcgacgtcttgatcgagggagaacgcatcacccaagtgggcggcagcatcgatcatgatccctcctccgacactctcgttattgacggtgagggcaggaagacactcctgtcaggactctgcgatgctcacacgcatctgagctggaacaactcgccgaccctggacggcctcgtcagtctgccacttgaagagcatgtgctacacaccgcccattcagccaagatgtacctggactgtggctataccatgtgttttggagctgcctctgctcggccgcgactcgacgtctgcatcaagggcgctataaagaagggcatgattccagggccccggacgctggccaattcacaggagatctcaacaacgggtggtgctatcattcccagcatcaccaagttcgccgacggggtcgatgagatgcgccgcgtggtccgagagttcctgtcgctggggattgacaacgtgaagctgtcgatgacaggagactacgtgcacgaattcatgggcagcgaagagacatacttcacactcgaagagacaaaagcagctgtcgaagaagcccacaacagaggcaaaagggtatgcgcccacgcccgcagttgcgcatcggtgaagctgtgtgccctagccggtgtcgacgttatctaccacgcctccttcgtagacgaggaaggacttaacctcctcgaggcgagaaaggaccaggtcttcgtcgctcccgccatcaacttcccgttgacatcctgcactggcgaggcgataccgtatggcctcacgcccgaaatggccgcaaagaagggcctgaagcgcgaagtggagatcgcagctagagcgatgaacgagatgcggaaacggggcatcaaggtccttcccggcggtgatttcggatttgcctgggcgcctcatgggacctacgcgagggatcttgctcactttgtgaatctgttcggctatacgcctatggaagccatcattgcggccacggcttggggcggagagatcatgggccatccggaggaattaggcaaggtgcttccgggatactatgccgatgtcatcttggtggatggcaatccgctggaggacattgaaatcttccagcacacagaacggatccacgccatcgttatcaacgggcatgtccacaaaaatatctctggcaagggacagccgaagtgggagccgggcaagacgaaattacctgttatgagggaggacggtaccgttgactggaagatggaggatcgatttggaacggccgtcaaggcataaaagtcatgtttttgtcatgttggatgatctttctgtgtattattctatggctgtaggaccgatgcagtctgactgacggcctgaagagaaggaaatgattgataagtacacgatgtattttatctccagtgttctttttgcgaattcgtagaagcagcttgactggacattagtatgcttccttgaactatcaatcaatgtgggcttatcgcactgaggcatatcacactgctcttcgcggtaacattcttcgatgcgtcttagtaggcctcatgggtcatcacctcgagaacactggctttggagtgaaattgagatttctgtcacagcaattagatcaatctggcactaatgggaaaataaaaatacgagaactattcagatcccacgatactgctaagtaacggaacagtcgaactgaaaagacgaggactcgacattggttccctggactggactgtagtccaacttggcgcgagtaccgatatttttcagcgtgatggatacatcatattagactctcatctaatcgttttcttgttatgagctgatcaaacgtggtagtacatgggacggatttggcaccatatttgggaaatatatgttttccatcgtgcccatacagctgccaagacttgtaacagaataagggatacaccaaaatagacagcccgagatttccacgtgaatgtattgcgaattttatatacgacatctcaggcattccagtccttttggacaacgataacaacgctgttgtccagctgtagtctttctcgacagaagtcgatgttgggtggaccggcaggaatcttccgctttcgttagtttcagtttatctactgtcaatcgtaatacggccgcgattattggtccatccgattgacccacaaccggtggtgtccccggctaccgggcgggaacatccgcacaagtgggccacgaccgcttccaatttatcgcttaccccactctgcctcgtccagtttaggattcctcgtgtgataggtattgtatttcgaatatttcatatttcttttatttattaaggaggagatagcacggactgtcgaacgaataagtctttgtgcagctgcggtgtttccaatttctgtttggataacacgggagtaaataactattttggctttgaattcaacagtgtgccttggcggattattctttgctaggcgaatgagactcgggaatatggaaaacttgcttgtgaaaattgtaaaatcaaagaaatcaatctagagtatgaccagtatcaagaatacagataggagagacactagctgcctttcaatctggttgagacacatctgcgagccggaaacaaggtaggccactgaaggatagagacttcagccagatttccagtaccgtttaatgatatcatttggcacaggctggtatttccgtaaggaagagagcagaatcaatctcgctggttggtctctgctgttataaacagcaatacaacatcctccttcttcttttgctgcaacctgttgggtctccttgattagttgaaccatcttctgcagagcatattggttcttcttctcccagtcatggaattttgccgcgacgtcaattgtctcgatcttcgtgaaatttccgtccttgtgataaccacgaactaaggatggtgtccagccaaaccaaagctgaggcaacgaactcgtgagcttggctcctccacttcgtgttgtaattttggcagtagtcgagtacggaacaaggcgcccacgctgtacgacacttgtggtgtgtttctgatcatgagacatttcactttggttaccatcaatgttcagtcttccaaaggacgacgtaaggtcatgatcctcagaggtattcctttcggtctctacctcttgatagctagcatcaacctcgaatcggacaacgcagtttgaatcccccatcttgtattggatgaccctgtggtgacttgtgctttcctccagacctggctccggcttggagatcgcgtgcacaaaattgtgaccaacccctgattcgcgactcccatgtagaaattccctgttggaccgctcgtgacggatcaagaagagcgtgttgtgtacgatgctgagatcgatgcgaaagctctcgcttcccttgtgggctgcgaggttgaacagcttgcgaaggctattgcgatctgtgatgagatcaacgtccgtaaatctgaactctggcttcatgacgtccaaggcccggaatagaggttcgaagctaaactccggtactcgaaacgcattttgatctatgaaaaatgtcccgctgtctcttggaagcgtgaaaggcacgtttctcagcgcaagtcgcgcaggcgcacctttcagtgtattggtcttagctcaactcgaccgaagaaagaagattcatctcacgtagatgcagcgatcgtctgtagctgtccaattgtaggtgcaaagcaacttaaagcctatttcagctgttactggactaggggagtctttgctggtgtcgagattgtcggggtggagggtttgcagagtccgacctgtccctttgatatgccaagttattcgcgaggctcgcaacatgctgttcatctcagcgtcgagtccggattgttttcgactcattgtctgttgtcgatcaagttgttgttgctctggtaagtcaccttgttggtgtaaagtgcttgaacggcccgaggctagattcacatgccactgactacctgttgcctgaaaagatggtcctatgagagtgaagatgaaagagtaagaagatgggaagagaaccgatacagaggtttgttgtaagctaagactcacgaattcctcacaggaatgggaaattttcaagttaggccggagatttcctgaaattaaaattccaaccaaagtctcaaaaatgaaatttcaatgattctttgactctgattggtcatcagggattttccaaaaaaaattcaggacacagaccaattttcaatttatgaaatttcacagcgcatgagatatctctcgtttgcaatgaagcccaaaccctctgcttgtctcaacgctcaacaaattcgacgtggcaatcttcctttccaaagaacaaagtgacatgcatgtagatcagaattaaatgttcttctactcagcgcaaaagcctaatagtctgacaatgagaaaagcgagtatcttcaaggatagtcgttatcctattagtgaggtgttaagtcaaatgctgacagcaaatactccggctaccatgaagaagaaagaaagaaggaaagaaagcaaggaaagaaggaagaaactaaaaaacggcgagagggacttaggagatcagagacagaaatcttcagcaccccaaggagtgatggggggcattcgagcctcagttttcatctggcttttcaccataaacgacatggagcttcgtatagagatggattgacagatccttcaactcccgccgtacgccagccagtaagacctctacctcattcctttcccagccaaggaaccgggtaaaaagtgcatatgtataggatcctagaccctgaaacacattgtgttgattgaaagtcccgatcgtttttagcttttcgtcttgtgaccatgggctctgcggcagctatgcagaattgaatttcaagttagcaggtctttcccatttgtgatttgggtgaaaagttctacgagggttgcataccttatattcttcccatttaacatttttgaagcccgctttttccattttctccttccaggtattcactgtagtcatgctttttccaaacttttcggcggctttatgtataccatctaccatcttcaaacagttttcagctcttttgtgcgtaccatcatcggagtatgtagtgactccaattgttttcatctcaaaaaaacctcctggtcgcagaaactggaagcattgagtaaaaaattgattatgatcccgaatgcatccttccagttcacggccgtggatgaagtcaaacttctgagaaaaatgccattcttgttcgaagtcgtcaatctcgaacctcacgttagggggcaccctactacgcgttaataaatttgtgatactggctagtcaaaggacagtaccatggaggttgaatgggactcagatccgttcctggatacttgcgacgtcaaacagagccataattatttggcaacgtgatgactcaccgatgacctctgcctgtggattttcactgtttgctgtcagttacagaccggatttatgacaactaataaacttcttactcggcaaagtcaatagcccaaatgccggtccctgttccaagatccaacactctctgaggacttttgaccggagcgcggtaaagatggccaccgagaacgaggttgtagacatggtgtgacttcatttgttagtcatgccatggaacgacactcagtgactcaccaagtctagtcgatcttgctcatcctcatcgtttggctttccaacgaagtcagtaatgaaaaagaatatctatccgaattcagtcgcttaccagtacgtattcgccgtggtggtacgaatggtatcggcgaccattctaacacacccttcagttgcgttaatgacgccattggctaagtttgtacaaacctcgtaccttccattctgttagtctcaaagaaacgctataagcaatatgtgaatggcactcacacatagttcttgacgctcgaagcaagtgaggtggtgtcgctgatgttaagcctgtaccgtggtgagcacaagcacaaggaattggcaagcatagtgcctacaagctctcaattgcagaatcaccatcggctgccacctcctgtatccatttttagtgatttggacggctacaagacggtagtctggaatacctccagcgcagcagcggcaatgggctggtctggtgcggcttgggacattgttgagcaacaagtatccctcgaattcacagctggcaagttccttggtagcgatgaaaactccagagaacatttgagggattcgagaaattaattaaaaccagcatacaaggctccccaacgctgttcggataaactcgaattcaacagcgatcgatttagttcccacggcgagttccggatcatcttccccgctcaccaatgcaagactaaatggaagtggcacctgtcatgtatgcacttagtggggtaaatctgcggctaaagagggaaaggaactccctaaaattgataaggcgttatggatggatgcgatcgatcaatccttgtccatcggaaagttgaccgttgagatactccaatggtcttgagagacaacggcaaaaaggaagtagcgacttccgtacctcatctagaattaacgagtcttaatcgtgtaagtaacgccgtttatagtaagatccttttccttgccgggactcctggagaaagtgagctgctctgtgatatggccataggaacagtcacttcataacctgggaggcttcatagtcatctcactgccagagagtttcaataccggtctttcttataataataatcgatagcatgacagtctcaaacggggttcatctaccagccagttggatatccatctgtgatgacaagattggcttttgccattaagccctgccagcagcacacgccactgtacttcaagtagacgaattttctggacggaaaaataaaatctgggaatgctctatggtcaatctggcgagcggggtaattgggtagatgcagccttgcggcgcagcaaaggctcgaacttgcatgttatacgcagtagaagtggaccgttcgttacacagcatgaactaatgttgggcctagcttagtgtcaaattaaacatgactacttgcgagatggaggaaggttatgtggcgttgaaacgatatccaataactgccttgacctaaaataaaagactgttcaagttcacaactgcagtaactgtcatttaatttctgcagctctctagaagaactcgtctgaagtttgaaatgtgcgactttggtctgttcaaatatattcctagaacataaatggactgctaaaaactgtcattgtatcctaaaaataacattgttttactttcatgcccttgtgccgctattctcaggtttccgcccatagacaacgtaactaagaagtcagttttaaagccgaagatagttaagaggaggaagaaaaactacttacaaatcaaataacgggtggatattgggattccggacatcactcctggtcttagctaccagaacgttgacttcctctggagaccatttctcatgtcttgtcagcaccgccaaagcggcggcttcaaaaccagtttcggcctggagtagattccaagttccaagagttttctattgcaagagagatcacgttagcaatacccccaaatcacaagcttggacaacttttccacatacgtaatacttgtccttgggccaggcgccaatggggattcggtacttttgaacatgaatatcttgaaaaccagcttcacgaaaccactgttctagacgcggtcccggactggctacatatccagcatttgtgaagccatcaatggtcgccctgtaatattgttcaatcgatgtacctttggttgaaccatcttccgagtacatgttggtatcccagtcctgaaactcaacccatccaccaggagcggtccacctaataaagttaatagagactctacaagagattgaaattgacttgacttgtatgcctgcttcagcagcctagggaaatccttgacagagcctgctaggtaacgggcatggatgaagtcaaagccttgttgattttcgtacacccactcatcctcgaagtcatcgacgatgaatttcacgtttggaggaacactatatatgcatcaaatgcttagttggcagcctttcgaaataaaggcggcgagttactaacaatgttggctgtgtagggctgagatctataccgtaaacctagtcaaaagattagagacgttcatcatcttccatgccgaaagggtgtctcacttctgctgactggaactggtcggctaggggaaaaggcaactggtaagcacggaaaccagacacttcagttcaatttcttaccaaagtccatgacccatattcctgttccagttccgatgtccaggacccgctgtggtgaagatccaataggcgcaaggaatagtttcctgttcattgtctccagcatcatttcatgaatcatatctagtctatccgattcctcctcatcgttggggatgaggtagcctttttttttatcctctggtcagttctggaacttagaattcgtgaaggagacgccttacgaccgtcacgatagccgtgataacgtctcccattctcattccgatagtcaaggaccgatgacgtgagagaggcggagtaggtcgaactagcatcaagtcagcggtttgttcggcccgtaggtaagtgagttgttttaacaattcttggccgtaagaagaatcattgtcggttgcctggaaaaacccctgttagaaacaaagctttccagatcctcgggggtacagacctgaaggtctacttcgatatttggaacatcttcactgtgctcgcgagcggtaccagcagtttcagacatactcaaatctcttcagaatcagctcaagcgcaagcgtttgatgccgggttaccacagagacagatcttaagcaagaggaaaatcggcgagcggaggtaatgaatgctagtaggaaatggataaagagccactctcgttcactattgatcactgtggagaaggaaccatagtctagcaggacttaagaacgcctgtaagctaggcacattattcctgctgtgccattccaaggctgctttcaatggctactacattagaaatagtttaacattcgctagaaacccatcactgcactacctattttagctggtcttgtagtcagtcccgacagctgagactaacactaaatgactcggtggaatcggctccgactactgcgagtgccgtcatatgattattctcgggtgtatggagttgtaaaaacagaactacagacatttccagaaatggaaggacatttctggtcaagccgaatactacgaatgttgagcaattcagcgagcttatcctaactactcctatgaaatagggacctttaatggcgaactagctgcatcggatctccgtaccaggtttctgggtgcaatgacatcgaatgtacatagattctacgcctgtcttccaaagcccgatcctaattctttatatatgttacctttttaagttcacagccttagatcaacacagatgcttaaaacaatgaattcagactagacactagactacatttttgataggaatagaagacgataataacaaatatatgtgtcatgaaggaatagatttattataaagtcacggactgaacccgtcgatcagcttccatcttctccattcatttcgaacgtcagttttcgtcaatgttgaaattgtttcaaccatagaacttcgacgcgctagaatatccctctcgaatatcaaatggccatttttttttctcgcttttgacggtctttatacagataggcatgactcatttcctgacactagtaggcattggcaatcatcgacaagaatctatatgcacttgtcgacagtatgcagtagattattatcctcatttccagtattttatttcttgcgcaactttggaagggaaaattccttcgaagctatgactcttcatctgacaggtgacctgagtcaaataggtgttgtgttcgcttccggcatgaagcagtgaatactgattattgttgatttaattcacggtctaacaacagtcatggcacatgaatagaaaacaaattccgcagaagacagttactgccagaaacatgagtcattgacccaggagtcatatctcacaaagcgtagaaaacgaaccttttccttccttctctatatagctattgaaagggtcttctccatatcatcaagcacaagaaatcttttattaaaacctaaccagctgcgctcatagtcttgaaattctctaacccttttatctcattcttggtatcctcttgggatcttttcgcttccttcggaaaaagaaaaagcggccagtaacactatgagcacgctcaaacggggcaacaaaattacaattggaaatgaaagtaaatccacctggaaattaacggagatgctgtttcattggggaccttttctcctcataagaggagtcgaggacgaacgattggtatctttctgcttgcgggttgatttgccggctccggcggcagtaatgaaaatcaagacgctgtacgtttaagatttctcgatgcctcatctcagaaagaaaatggtgagtcgattcattaatgagaatggcaggatattttcttcgccccatcgtcaagatgaagtgatgcgtgccatcttcaatgaagataacatagtgcaccagcagattcatggcatcttcaatgaaattgacacactggacgagctgactaaaaagggatgcaaatcaactccaaaactgctggcattggagaaaatctcgaatgatgtccggcgtacttgctgcatcgttatggggaaggcaccaggcattagtctggtggacccaaagactggataagatcacttcttgaagatgagcttggaggaacggactgaaatccgatatgcctttaaaaaggcttgggagtaagatataaccagtcgctctccttttttttttctagctatagtaataactgacactccatacagggaatgcatccgctgtgggtttaagaacaggtatccccgccgggaaaagctcatttgggaccataaggagaagaaatggtcagtttgttcaatataatgcccttgtaccaaatgccatgaccgctgatgcatttccacagttggattgctaactgggagctagcagaaagagtccccgaatccacccagtgggacgatattgaatatcgcaagtgggtgttgagcgaaagccctggggaggagcgaggagcccgagtctctcctgccacctaatcgtgtccttcttccattttcggcttatgccgctttgtgcgagtcattctcaatttgtagagtagctgcttcctagatacttcatttaatttggttccgggtttttcttgaggagtacttgccagaggcactttactttcaagccactcgaacacttgctaacaggctttggaaagcccatacaggtagacttgaccatatacaatgcctgtagataataccttcaaatgtagtaaaactgcgaagattgtgcagatttggagggcaaagggagccacgactcaatcagtgctaaccacgcgagtcgattttctatatacttgtgcattatggatggagttgatcgatggattcaaaaagtgagcttatgcaggccttaagcatggtctacttggaatcaggagggcgtcccctgggaacactcttgagccactctttgcaagaacctcacagagtcttctgggcatagaggtgacctgaagttcgtctttttacttaggctcgactacctgactgtatagacttaattgaaggttgcgtgaaaaaatatatatctcctaactctggagattactgttgcgtgaaaaaaatataaaaccctagattcatttacagtttctggaacccagaacttttactgaaaattcccttattctgatccctaaatctatcgggcactgtataaaaccgagctcaactcacttgttaatagaaaatacagagtaaacccttcctgtctaatttgtccggtcctttatagtgttatccgacgatgtttatcaacattttcacgcttcaaaacgaccgtcgcccgtgacagcgagcacgtggggcgcggaactcggaatgcgtagccgacggccggcagaaaccagcgggacaagaagcccatgcgggtcgctccacgccgcggcggccttgttgacagttcaacgcggcgtttttggcgctcttccgcgaggatgccgggatctaaggcctcagacgatcttggcagccaataatgtcgtcgacttgcatgcactagctcatcacagcgtagaagccaactatggttacatcgctagacgtggattgcgcgatggggcaagcagatcagccgcacgaccgacagatagttagggaccctgtcgagtccgccggtccctggtctctctctctatccctgcctgttctactccaggatgcctgtcatcatggctgagagagccctccaggagacacagccctcaacccagcaagcgctaactgagggtcccctgcaaatagatgtgagatcccccgcgacgagatcgaacgtctaactgacgcgatcggcaggagaatgacacccgggatgctgactctggctacaatgagtcgtgagttttgttcgcggattgattggtcagcttctaatcgggcagtagtttttcctctggggactacttgtcgtccatcagctccagcgtcgtaaactacaagtacgtcgacccctgcaagcgctattcgacccatgtctaacaggctacgcgtgagtgggcagatacgaggtgcgcgataccggagtcgatcacctgcagggtgctaatcgtgctgatctcatgctaacggacgatagaatggccgtcgttatcacgccttcaaggaaggagcatatctagcggtattccacgatcaacgatcaaccgtcaacgatgcaagtgtcagtcactgaccctgccagccaaacgatgaacaagagcaggagcgcatggacctggtccatcacatctaccgtctactccttggaggacggctccatctcgcgcccatcaagccaaatcctcagcgagtcctggacctcggcaccggtactggcatctgggcgatggactttgccgagtgaggagccttctcgtaccaacttgacacgcaactgatgactgttccagcgaatatccatctacggaagttcttggtacagatttgagtccgattcaaccgaaatggtagcgcagaatatccatattctccttaccgccatgctgacaaaacagggtcccaccaaactgcctgtttgaagtcgacgactacgagtccgaatgggtgtattcccgcccctttgacttcatccacgcgcgggaacttgagggctgtatcgccgacgacgaccggctcttccagcaagcgttccgccatctgaagtcagggggatatatcgagctgcaggctgtgagcccgtacttggtttctgacgacgacacggccgaaaaagcgaagaccgttcagctctgggtgaagacgctccgtgaaggagggaaacgattcggcaagccgttcgacaacgtcgacaagtggaagagcaagttggagaaggcaggattcgtcgatgtgaaggagacgatatacaaggtgtgtcgttaacgagaaaacaagtctttggatgagaacgacgctaagtcataggatgtgtgcagctgccaatcggcacctggcccaagcatcccggtctcaaggagatcggcaagtaccagttcatcggcgagctgcaggcggtcgagacctacacgccggcactgttctcgcgcgtcctgggctggagccacgaggagatcaaggcgctgatcgccaaggtgaagaaggagctgaccgatccggggttgcatctgtatcttccgactcatttcatctacgggcggaagccgtagcggatattttttttcattgcttgctgcgctacaaacggtatttatatattttctttttccgtattttttttccttttttttatttttcaagaagcgatgaactcctaaatatagaacatgcgcaaagtacaaagttcttttctgttcaagttcttcctggttttcgagaaagatttctgctaaagtttaggcaactttatgttggagaacccgcggttatggtgtcgagaggcagtaccagactacatgggagctgatataaaatcactaatccagctcttgttgtcttgccaccgaatacccaatgctgttgagccaactactactttcgctctctccttcacctattctcctctgccatggtccattgctccaaatacagatgctagctaccatttcgctttgtttgattccgtctccaaacaaagaaaatagatggcagcagccctttttgccgacacgttagcacggggcagatgcattattgaccaaactttggcagcagatctttgtctgggtgagagccatttgtataactctcccacctttcaacctttcccaacaccagagaagcagggaaacaggctacaatacatcctctccaaacatgccacgcaaagcaagaggcatgcttgtcatagcccacaagtgaagacagtgaagctgactgtgcaacaggaaagcgcactgcgaggccacaagcagcaacaactcaaaaaccaaccatgacaagcgccgtcaagagtcaaaagacaaagactctgaaacaacccatcagaagaagtgctcggctgatggagaaagatgccctccaaaggcagacggtatgtcagttaaaagcgcactgtctccgtcgcttcagatccataataataattctccctagaagacccagcagattccagcacaagcaggctctaccagccagaaacaagcgggtgagtcagagggtatctcggagaaaaatctctcaagagcgaaaagattagatgcgacaagtgccctggaacattgggtccaagagcacacgtggccggagggattcggcttctcagtctgcactaggagcatgtctggctatcgttctacctaccccggtagcgatctcaaatcacctggtcgcactgaatcggcgtaccggaacgcacgctatgaactgcacctcgaacaggagcgagtctacatgacactggacgcatgcggcatcaacgacaggagcaaggagtggtgtcgacgactggcgacgacgcagcatgaagtgccgccgcgcacactgttccgagacgacttgtttgcgtcgacgattgagagaaccagcggcaacgaaatctcccttcttaggctgattggagacttgattgtcccctcagccgtctcggaatccgccttcagaggcttcgaatttactcgatttgccgaagcctttcaggagacatgggtggattgcaagcctctccaatatccacccccgccacgcccggactatgcgctgggatttccaccctctgccttctcggagcaccatcggcagaggctcgcccctcttctgggcggcgttgaggacccatcggagctcaaggccacgccgcgcctgtacttcccgtttttagcctgcgaggccaaacggctcggcggcgacctgaaggtggcagatcggcagaacatgcacagcatgacgctgggcgtgagggcggtcgtgacgctgttccaacgcgccgagctcgccaaggagctcgaccgagaggtcctcgccttctcgatctcgcatgactctcaaatagcgaaaaatctacggacactacgcagtgatcgatggagacaacaatgggcacgtttgctactatcgttatcccatcaaggacgtctactttcactcccctgagcagaggtggacaacgtacatgttcgccatcagcgtataccgcgactgggtgccggagcatttcaagcggctgtgttcggcgatcgagaaactagatttgcccggcagatgcagggacgaacgggacaagtctgagtagagctaggaatacgacgttattattattgtttttttttttgctactttgtgcgatttcattaagcgctaatgttagttagccaaaagattcaactgatagaaaaaaaaaaactggtacgccaataggccttactaaccaatcttggtggatcaaaaactgtttcttgataattactaatggaattggatttcatctcactctcacttcaggcattagtctcggtcagtagtttctttcagcgagcaacgcaggagaagtagggtaattaaacgggctagagctatcaaagttgacgcctgccattggaacagccatgcgtggcgtgtataagatttcaaatccttccttcgccgctgcaaaggattcatcataactttcgatgtatggaactcataaatcatcctattctaccggaaatggtagactctagatgagttctatctccgcgttgcgattcctttcccgtcatatgtcccctgccatcgtttccgatacgttttaattgtcttggacctgtgttgcggccaggtgatcctaagacacagcttggcagtccttctcgctggcatttgcgttttcgatttctactgtggcaattagatactagccaaactgcccagttgtccaccagagtatacccgtagggttaactagttaggtcgatggatcccacgctccagatctggggagaaagaggcataactgtctgtcatcaagaacacgtctacatgctaggtcgcacaaccgatccctattgcaatcgcatatatttaattaaagtgcagcagacttcctcgtcctcctatcgacatcatctctcctctttctatcctttgcagcctcgatcacccccttcatatcaactgcgagattctgcattccccggatcttctgacgctcgctgctgctggcggtggcaagagtccgaaagaacggatcggtctcgcggcaggtttctgagtcgttctcgaagagccgccggatgttggcctgcgtcgtggggtcgacgaccttgaggaagatatcgcggcgcagctcggcgtatttgtcgaggaccgtgtcgggtacgtcgttgttgagaacggcaatcaggcagtcgctcagggcgccagcatcgagcaggcctccggtcagacctaggctgtattgcattagttatctgcggggttgaactgcagaactgtaaactcaccccccaaacggattacacacatgagctgcgtctcctgccagcagcacacggcccacgcggaaggtggtgctgcagcgttggtggatgcgataaggcgagaacatcttcagatcgtacttcagcggacgtgggcctggaaacagggcctcatacttcatcttcaaccgttcgcgcagctgctccgtcgtcaggttcctttcttcgccgtacgagacgcgccagaggccttggttgttgagcttggcgatcacggcgaagtggtcgggatggctgggttgtcagtataatcaaggaagcgagaacggtctggagaaagggcacgacatacacaatgttattccccgttgtatagccgtatttgtcgaacggatacaccacgttggtcgccacaatctgtcggtcccaggtgaagccttcgaaggggatattcaaatgccgtcgtacgaagctcctcgcgccatctgcaccaacgacatactgggcccggaatctgtgctcgcgcttctcctcgcccacttccgctgtcaccgtcacgccctcctcgtcctgctcaatcttgaccgcacgatggctgaagaggaccctggcgagcgtctcctcagcggaattctcctgctggaaggctctctgaatcacctccgccagctcgtgctgtcccaggatcaggttctcgtacggctcctcttcgttcgggatccggtccagctcgacgataacctcgccgttgatcttgcgccacgccagcttcgtgccagacgtgccgatggagcgacactcgtcgaggatgccggcacggtcgagctcgcgtactgcgacgggcatgtacaccgctgcgcggggagagttttcgactgctggcaacatctcgagtacggttgttgggatgccagcgcgtacgaggcgcaaccctacgaggagaccgacaggaccggcgccgatctattgcattcgagcattaggcatgaatcactcctatgaggaaaatggagatggaattgactgtatcgtaccacaatgactgatgctttggtgtcaatttcgtctgctgacatggtggcttatatccttgctggagcaaccggtggacgtaagtggatatgtgattgcataggtgagatgatttccaaaacgtcgttttccagttcggtcaaattcgtctaatggaatatcctttctttcgatattccccatggcaagcactaatttattttctcgagctggaaaaacggcacaaagccacgcgaatgcggggccgtgaaagcctccttatcgattgcacgagaatcgacggcctaaaactggtcgagaattgaccatcttgtggagaggtttatgatcaggtggggaacttggtaggagcaatcgatggttatcgtggaccccacatcaatcagcttttggacgcgattaacgtagttaatggtcaaaccgggagagattgacaaggaagtaaagagacgagaggaaggagagggagggggagggcatcctctgggccggttataataacaacaatgtgtgtatgtcctttgatggacagcatttctcgatcagaccgtagcatagtttaatgcaatgaattcagacccacctatcactattagaaaatctcgactttaccacttctctattctttttagcctttcttaccgacttgttaccaaccacggctactgcaatgtacttacacttgcgaacccttatggcgcaggctgatgcgagaacgggatctgattattctgatcccttcgtgtcaggctcattagcacgcgtccggtgaagatactgctgcctgcctgctagcggtggacttctcgaagccagaagtggaatcacgtctgcttcctgaacaacagccgcggcagcagccagcctagtgggaaaagcctgttcgtcaacgtagtagtagacatcgacatggccttggattagggtcagaaccgaatcaggatcgactttcgatcagcagattgcagaaagggagtggtagcattgtgaagccttttctgtgaaagattaacctgtgcacttagcagtatgaacgattgatggggaggaatgggagttgatctgtcgcatatcatgtggatgtgtaagcataacaatctgtcaaacaagctggggcacaaaagaaaaacctaggttacctagtaaacccctagtatgattgatagctgccggttgacacaatcttaggaccctctcacttgcaaaatcccatgtatttagctgataatattattatacttttcatacatgcatggatgacaaattaaagagacctcaagattagccgaagcttggattctttctgagaaaagctgaggcgaggtgctctaggcaagcaccggccctacctgctccaacactaaggcattgaaagatgcgacaggggagcatgtgtcatgggacaagtaagatgatgcttatggtaaccattatattgctgccgagctgtgaaaatatatatttcgacaggtcggaactaaaactcaatcacaaaaatccatgtacgaaggatattgatcatcaactatgcaattcttttccatcacatgacttctcacgtgtcagtatgtatgctggaatatctacttccaatacaacagcaatcaatggccattgcagcgatgtcgatatccctggtcgactgcatcttatctgatccactggatccccttagatagcccacgcggggtacttgcatatcgcagccaatcgaatgatgcgctggacaccaacatctgccattgcaaccctgcctagaggtccggattccgaattgccccagatacaagatgcacgatgactaagataagattatcagcttgtatcacgttgatcgattgtgaatcccacaattgacttccttcgaactcgctctcataccgtgtcttcgacttgaagcctgctccttaagactcaacttctaccatccgtcaatcatcaccatcgctcgctccgcaatgtccgaacagcccctcttcccccacccccgccgcgtcgtcaccggccacgacgagcatggcaactccatcttcgtcgccgacagcgaggtgccgtgtgtcccgacgcctgccaactgcaatttcgccgtcttgtacgagacgcaccagttcccggcgtcgaacgacggatgggaggacccgatcctgaacaagacgaagtcgctggccaatccgaatgggcttgtgttgcgagtggtggatttcaagccgaatacgaagacggtgagcctgcccagaagtccggcttatctggcgtatcgctgacgaggtgcttgttccaggcgttccaccgtactgaatcgttggactttggcatcgtcattgagggagagatcgtttggtatgtcactttccgttgaaggaaattactagtcgttgctgctggtcctgctctgctaacgaagcagctacctcgacaacggcgccgaacggacctttaagcgaggcgatgtctgtgtccagcgcggcacgatccacgggtgggagaacaggacggacaaaccggctagagtgtatttcgtgctgtctggtaggtcacgtctgcttgtatcttaaataaaatatggtgatttctcggaagtattgatggatgctgacatctctctagcggcgaaaccagtcaagatcggcgacaaggtcttaggaaatgccggttttgaggacaaagatgttgaatcgggtgggaaatagcctggtatggatcacagttaagaagacttgaaatagctcttgagatagttataggttttatctatagtagtaaggcaatatatcaatgtccttatcaagcttacctgactcttagaggtgtatacagacagtatatatgatgaatgatgtgaaaactagcagtaacactgacagtgacacttttcaacatctattgttaaactgtggaagaggatagagaggataaatagcaagacatgagatacaacttaagacttttcctttgtttttcctttctactctctttctcccccccccccccccaataccttcttaactgcattggaaattatctagtcataagacctgagattagctcaggttccaaagtgttgaagagaacaagcacaataaaatggtttattcttacagataagaaatacaattctgatactagtaaatctagaattaacagatataataaaacaaaggccggactctattccaaaacaactatacttacaatagttatttgggcccgtgccaccttgcttagtcatcaatattgttgactgagcatgctgaccggccttatggaatagcaatttgctctcaacaaaaggtatgaaaggcttacaggagatagagcagtaggatggtctagcaaatctagaaaagcataccaagagaatacaatttagcatgacaaagaattggtagaatcttggcacttaaaatgacaaaagctgcaacttttatagaacgaattcctgacttcaacatgaattataagcccaacattgagttatttttttaaaaaaaataaataaaacttatatagatgtaacggtataaatataggtatactaggttaaaatttgaaaaataaccaaattttaaacttatacagtaatttaagaacaaaggcttttttaattttttgaaaagacatattttttacagcattatctccagagctttttctttttaaaaaatctttttctagaatatctcaattattacttcataattcatgtttaaagtcaggaatttattacaaatctggcagttcgtcatgattttaagtgctaagattctaccaatcacccaacaattccgtcgcaagactcgtctagcctaaacgcagagccatagggcatggaaaatggatcttccatcagatgagcataatcagaagcaggcatggtcgctgcaagcaatgctgttgtctggttttattgcatgcaaccagcggagatcaacatacgaccagactgccatgattaattaaaatgagtcatagcgattctagtggtgacgctattttggcctagagataaggtaggtcgcagttagctctgggagctactctgctggacatgatcaacattcatttagtggtatgcgcagtaaactcctcttccttgaatcctccgtaatggcttcccggcttctcaaacggctaagcattgacagcccctcttcgtcagaaaaatcagtcgtcacaaaacccatctgatcggcctcgacgagtcgacatgcgaagtggacgggcggcgctcgaactgggcgaaaatgcccatccccgcgccgggccaggaccgcgagctgcctcccaacccacgggctcaaagccgcttcttcgctcgactaccacccgagatccggcgccagatctatctgcacctcttcggcgaccgtcgcgtgcatgtcgaattcgacattgggacggtctaccatcacaagctgggcatggagttcgaagaaaggcgcgagaagtggcggtggtggcagcagtgaacaggtggaattctatccattatgcttggactttcgctgctgttggcatgcagacgacagggttcgtgcaaaggccaaaagggagaagaagccgctgcgccagttcaagccatggacagactcgaaactgggcggatggagctggttgagatgctgccggaaagcgtattgatttgtctcctttcattctggtcacttgcatggttcaaaaacagagctacagatacaaagagtccctcaacattctctacggcagcaacaccttcgttctcgccagaaaagaggtaatggtctttcgactcgccaagctgtggccagcgagccatcgcgcactcgtcacgtccacggatatcctgctgccattatggctcaaatgcatcaatccggtgccagaggatatctacagcgcgtttttcggactcctgcaaggcgacgtctacccgaacctgcgcaagctccgcaacatgctcagaatgattcctcgtaccgtatcgttcgagcttcgcgctccgtctcccttgaccgaagaacaggaggactcgtgggtccggccgtgggaggaactagctaccagccgcgcgcactgggagagattggagattattgtcccggacagttggaagccagactttgagaaggcgctcaagagaagggccaggctggacgggagtgatttgaaacttagggcgcagagtttcctatagctatggctgatgatgacatgcgatgctgatctcagaggtcggaatagaggaatgaatttcactactgcgtgctctaaaacttcctttcaaccgcttccttcttgatattcgagcagataactgttcttttctacttttatatttgcagccttttagaagctgattagcatgtagtctttatataaaccgaaaagtcacacactatcaagatgttggggtcaagagtaggaatatcccttaaatcagctttgttaaacaatcatatcatgtcattacctacatcatgcaactccacttcttgccatcctaattctcgataattcgatgcccccgtggcagccgggtctcgtactccagcaccagtcggacctcttttccccccagctgcgagatctgccacttcacctcgccgtccttctcgaacgaggccacgccctcgccccattgcccgtctagatgagtctgatcaccctcctgctctaggcccttcggctcgaggatgttcacgcgcagcttctcgtcctgactcacggggacctggtccatggcggagatcgacaccgcggtcgtcttggtgttcttgatccagcatgcccgggtgaacaccgcagagtcctccttggtgaggagtcccgctgtcgcccgtcggaccgtcggagggccgtatgctacgagaatggagggatccacgctcagcgacagattgcagacattgcccggggcacaggcagcgaaggggaccgtccccaggaaggtgttctgcatcttcgccgtcaggaaggccgccggacgcagtttgggaatcaggacgtgcgacagagtcaccgtcgccaggtccagctccgccaggatgtgtctgcgcgggacgctggatgggatcagggtgcgttggccaggcagctcgtacgtcgtggtcaggccgtagtcttgtcggacagagctttcatgtcccagggctgggggaagggtcatggtcgcgctgtcttcttcttcctcgtcctcttcttcgatcttgttcgcattggtgctcgtcagtatcttgcgaggcgccttgccactgaatctgcgtcctatttgttttgttctgattctcttgaccccagttgcttcctcttcagcggagacatgagggcgcttttggccctgtttgacactgatctccgtcttgctctctaggacactgttccaccctcctgtgtcgtcgctttctgtactccctagcttgacgtgccaggcctgtagcgctggcacacgctcgtccaggcgtgtcagacatgatgttgctactgtctggaatctgcctgtataggaatggtaagaagaggagaaagaaagcagggaatgcatgttagttagggcttatataccctcccgcaggccgctcgtctagccgcatggccaacagaggcgtagattaaccccccaatgcagtattctgagtggatgcattgcagttgggctaagctagtgagagactgcgtatgccagtcatatctttattctgcattgtttacaggcccatgactcatgtgagaagcaatcaagttgggttgcgcgtatcattccgaagatatacagacaggtacagaatccaattgatagtgcataacattgttcttaccaagtgcaagttctttgaagagtactatctatcccagacagctgtgttgattatatggtaccatacaaactttcctctctccatgagtttctgccatgcttaggatagaatcatgatgcaaaagcatatgaaaattataaactctgtagatatataatagatcattaaattttttttgtagatatacgattgttgtaaacatatgtacctttcacgttgcagaatgagatgtcaagatatcgcgcacagatcctaaccaaaggattagggccattaatttaggaatataaaataaaagaatgtctccttcataaagaacccccctcctcaagaaggtcaaaaaatggaggacaaaaaaatgactaagaaaactcacccagttgatcatctccgctgcatccatccacctttgaatttcaccctcctgaaacatggccaagtcgttgcaaggggcagcctggcccagacttgaaagttctgacgaatcctgtgcattgtcctggcttggaatcgcgggcaatggttgagcgttcgatgctagatgctagtgttagaggacaaaatgtatgtacgtaaaaaactgagataacgcactttgcaagatgtcagaattatttacttgcgctgaagatgggtccttccggtccagcttcttcagcatgatgctgagtgtgcggtatgcgctcaacgcctcggcggactggctgctcgattcgcgccagctggcgtgtgattcttcgagctcctgcagcagctcgtcttccgtgagagaggaggtcgtctgctcgatctgatcacgacagcgctgccgatgatcaatgtccagacaaaggatcatcgcggctagcaggaaatcgtggctgctgagagcggatactagccacttgtcctcatgcagcaagccgtctggttttgtctcggcgtggatcacagcttgatgccgaaggatcttccatgctgcttcgaggcaggcggttcgagagtaagagtaccgtggctcggaccaggccaggatcaggtatttgcggtgcaggatacagacagtcttgaggaacaggaggtccagattgaatcgctgcatgatcagatggtgcgggtcgaggattgaactccgaacaggtcgcatctgcaacggcggcggcatggaggcatacgtgtctcgcaactgccggtcctagcgcatgatctcgtcatagctcacggggcgaaccgagccggtcaggtctgagatatgcccatacacagcggcgagcttggttttgatgatggtataggagacgccggtgagctcgttggcaggtcgccccgcgggcatcacagacgtgtttttatcaaagtcttggtcgtggagattggccgggggctcggtgtctacctgggagagcttggtcataaaaggctggcccacttgccctgaccccagaatatccagaggcatcaacacagcccacacgcgacgacgcatctcggcgtcaaaggcggaaatccgacccgggtagtggctgggatcgcggtggtagcccatgcggaaggcgagtctgacaaccatcccaaagaccagccacagcccgaattgcgtgtcgttgctgcggaagtactccgaggaaagatacagcaggagcgtttcgatcgtgtagggcggactttgcgtatagtcagccagcttcaggcattggaccgcccggtggcggaaaaggaggatgctttcttcaggatcagcctcggagtcgagcactcgacgtccagcacgcatcgaatacagcgtcgccagacacatgatgcagaataacagcccaagccacatgacgggtgtggtctgctggttttcccagaattgttcatactgatacatgtcagcgtctagatttgaagtcgtttacctagcctacctcgacttggaaggtcggcgtatggataatgactccacaagtcagccgctagcagcactgcagatcactaaaccgactacctaccagatagtccatccacaaagctgaagtaacgagataccagtcgatcaacgatgggtcgcgggggtatcgaactgagaatctctgctttggtaggaaggtacgaatcgctgcgaagaagctcggggccaaactggttgtcattcgtcggtccatgctgtcgctcgagctcgctattgctctcgaggaattctttcacttctgcgatctgcatctatcagcgcgcgatcagatatgaatggatgggatggacaacattatccagaattgccgcccagtgattcggtgagacatatatcgtctctgcgtcgccgatcttcatacgtccgatggactcgctgacttctttgcctgcccctgcttggtgggaagcaacagcgggaggagtcgacagaacaggatcttcctgaccattcccccgctgatcgcgagctactacatcttggctgttccgattctccaccagagaccggatcagctgctccaggtcatggatacgtctgcgcatgtggacgatatccgaatcagctgggccatccgacttcataaagcggcaggacgatgccagaccgcgtctgacgcagttaccacatggatgattccggtcgcatcgcaatctaaatccagtcaggacacagaaagtgaagagctgattgaaaactcacttcttctgacggcagaaactgcaagagagctgcagccgttcctttcttttcggcagagacgccatgtcgtatgagctccggagatggctgtcaattccgatacaagcaatcccagtctatgacgcagttgcaacagcattcgtttggatgcatcgaacgctggagtgggctgggtgcgcagcggtgataatgacgaaatccggtaccggagataccggggtaattttgaatcgcggtggaagagctcggtattatttgtaatgtatggtaatgagatataacccagtaaggctagaatgaggcatcagcattacctacctctgttgaactattctggtaattactacaagagtgaaagcgtgctctagctgagagttgcctgtgtttcacaaatacaacgtacccaaggtatgaaatagcatgagatagcccgggttggttgttgcgactccatatatattcatttcatgtgacatgtgaatgcaggcaggtagatgtagaagtacaacagctaattcagacgacacggtttttgtttcttctcgttatttattcttatgttcttcttcatttttattttcctctttttttttttcgcttatttcgatttatcgaataatgatataatacgcctttcggagaaagcactgatctccgaagctattacagatatagacggcgctgatggggagtggatactagtaacagcgccagctctggttgcctagtttacattgagagaagacggatatatattgcacacttctagaatgctgttctgcagttgccatctggttagactgatttttcttacggcatttgtcgataattagctaccaacctgaagtatataaatcgcttttcctgcgcaattcatctgattgaccccaaacaaaaagcctttcatactcccaattgatattgacgcaccactaatcattgaataattgcctgtctattaacatgtcgactctcagccaggtatttccctgtcctccaaccttcaccgaacacaatctccccgatctatccggcaaggtacgtacgaacaagcaaaccgcagcaatagcaacaagtggattcaatttttaattcgttctgaattttatttcttaggtattcatcgtcaccggctccgcagtcggagtaggatacgaactggccaagatcctctacgagaagaacgggacggtgtacatcgcgacgcggtcagaggagaagatctcccgggccatcgcctccatccggcaggagcatccaaacagtcgagggcggctcgtgccgctgatcgtcgatctggcagatttgacgaccatcaggccggcagcaaggacgtttctggagcaggaaagtcggctcgatgtgttggtgcacaatgcaggtgtgatgaggccgccggcggggagcaagtcgaagcaggtagattttccttcgtatacaatagagcctcgttcttttccaatatcgactagagctaacgcttgcagggccacgatctcgaaatggctaccaactgcctcggccccttcctgctgaaccaccacctgcagcacatcctcctgcaaacggcccatcaggccgcacatcccggcagcgttcgcatcgtctgggtgtcatcgctgctaggcgtcggcaccatcaagggcggtatgagttttgaccctgagacaggcagtccgaagatcccgtcggacccgatgagcaactacatgcagtcgaaggtcggaaatgtctttctggcgcacgagtgtgcgaagaggttgggaggggaggggattttgagtatggtaggagcatattcccttttagtagggcaatgtctgcatatacattacagtactaacgtcgccttagagcgtccatccaggcctgatgaagacagagctgcagcgacatatgaatccgatggtgggcaaaataatggtatgacgaaaaaaaaaaagggaactttttttaaaaaaaattcattttctaattaagcgacagcacctcatcctcaaacccgccaaatacggcgcctacagcgagctttacgccggattctcgcccgatgtcacgctcgaacacaacggcggattgatcatcccctggggacgtcacggcacgattccggaggatattgcaagaggactgaaatcgacaggtgaagggggcatggggctctcgcagcggttttgggattggtgtgttagggagacgaggaggtatcagtaggttagtttagtatgtatacagtacgtgtactgtacatggagtataatatatggatgtagagtaccataccagtcattgtgttcagattcctttactcttaactcagtgtgtactagcaggatagtttccagccatgggcagaatgaggtgtagaatatagtataaatacatatgtacagtacacacactgtactgagataccagtaactaacgtgcccagtgcaggcctgtactgttcagcctaaaactggaaatattaggctaagctgcagatagcagataaactagataataccgccgaaattttcccttccagatccagtctgcagtcgatgcatttccttttcctatctgggtaagttatttgcactaatcattcaagccaagaccaacaacatttcatgcacctatctaccagatactactacttcccactaagtaagacagctaataacagctaacagcgtccagaggacggactcacgagactagacatcttggcgatggtctagctgggttattagttccaacggtctttgtttcctctagctgtgttttcgagtatcctcccttctcccttctctcatgctgtatgcgaagtattatattctacttgctcttatctgacatcaacccagaagcaaacaggtatccccttactctgtataagatccaaactggacagcgcttaactttacttgactggattcatgcctcatacggagtcctacttgttcataccactgcctctcttcctcctctgatttcacgacatcatatacaatcaaatatactacgtgagcgatacttccaacgttgatactgagttttcttctgcacgtcaccactgcaaccgccacagccatgatccctcgcgacgacagccaccgcggagccgacagcaaacctatatcgagcggacccgggcccgtcctcgccatcgccctcagcgcacccctaggcgggctgctattcctcgatctgggcatatggctgtgcaatcgacagattagcgggcggaggaccgcggcggcagcaccgtcagcaccatcgcaaggtggcgatgcgaatgcgaattgcaactacagaacagagcactgcggctggtcacagtctgagggagtattacgctcctgcgcatatgtctggtgggcggggagaataggtatgcatatgcagctagcaaggcgagtcacggttgatggaatattaatgtggatggctgctctgtcattggatgtctggcttgcagtacaatccaatacatgagtgaatgaatagatcgaatcgattaatacaaaaagcagcatgatagtcatacagtcgacatggatggaaagaaaagtcagaaagaataaacgttggcgtttgcgattaactctatattggatcttgtccgaatcgtcaccgagagattattgtcttgcctgatcatcaattatctatatctaaaaggaatcgaatttaaaacatacacgctagctaccagtcatggacatcatcaaactaccatcaaattacaatcatctcactacttgttgtctcaccacttattgtcaaacaccttcccgttgacaatgttgaccagctccctcaccggcgacagatgctcgcggcccgcgccaaactgcatgccgtggcgcatcaccttacggtagttcttgcccggagacaccttgcccagcacatactcctggcgcgtctcgacccgcgtcggcaccggaatcgaccgccccacgatggcctccatgccctgccaggcgaacgtgatggcctccttggcgcccgcggggatgcccgcttcgtccagcatcatgatcttcgtgttcgggtagtgctgctggatgtacttggtgatgttggggttgtaggcgccgccgccgcacataaagatctcggcaatctccatgtccttgggcgcgtagcgcttgtagtggtcgacaatggcctgcgctgtgatgcgcgtgaccgtggccacgacgtcgtccgggctcagcccctttgcttccgccttcttgatcaactcgaatgccagcgtgtcgcggaacacctcgcgtccggtcgtcttgggcgggtccagtttgaagtacttgtgctggaggaactcgtccaccagctcctggtccactttgccgcgagcgcccatctcgccgtccttgtcatactcgcgttctccgttggtgtaatatcgcaccacggcgtcgatgaagacatttccggggccggtgtcgaagtcgtagcactcgtcgatcccaccagcgttgtccggggggatgaagcacacgttggcaatgccaccaatgttctggcaagcccggagcttggtcgggtggtgcagaaccagggcatcgaaaaaggcaatcaacggagcaccctgtcgaccggcagcctggtcgctgacacggaagtcggtgacggtggtgatccccgtgcgcgacgccaggatcgagccctctgccatggtcagggcgctcttcacctcgccgggttccggcatggacagcagccagatggtctgaccgtgggagccgataacgtcgatactgttgatgtcgacattgtactccttgcaaaactccttcactgcggaggcgaaggtctctcccagaatgacgttgacttcagacaactcggatggagaggtcttgttgtgcaggatgatgttcatgacgcgcttcttgatggtctgctccagcgggatttcgccatactagattgatgctgttagctatcatcgccggtgaatgactcaaacgaccttttgaaataagataccttcaaaagctcgaattgcatgggagaatcgggagtttcttggtggaagtggcacagcgcgcagtcaattgcatcctacagtctcctaatcagccgggtgattcctcttgcagagcatgaacctcgcttcactcaccatcgaggttccactgttcagacctaggaccgtcaagtccaaggccgcgccgtgggtgccattggcaccattggcaacaccgttcgttgctgccattgtgactgcttgtctcgtagactggggttctggaaagcactgaacaggccgttatgctacacctgacgccgatccggtctagtcagtaggcagaactgcaagagaattgcaagtcctctccatcccgacgaggaggaggtccctggttaatatatatcttgcagagacggcgccggtgagtatccctggaatcccgaaatgcgcgactcattgccccggaacgaagccgactccatcgcggacagtttggttttcgcctccgtcgcccagtctttcgaccgtgccatggtctcacgaggccgacgaagcgatgaagcgacgaaatgcccgtcttgccgtgtgcgcggccccggacacctgctccattgggcaacggcggagcggcgggcagcggcggaacggcagaacggtcatgtgacggctaaacggctaagcggcaaagcggctaaacgcttcaaggcgctttagttccgcccttcgcccgggcgcctaaacggctggcacggcggcagggctggactgccaagccctccgcagcgaatctctccgcagaaccacagggctgggccccgttccccgtattgttctggagcgtcgagccctcataaggcgtccgccggctctgtcagacagtcagcaaaacagtcgagcggcaggtggcatcacggaccgatggcgaggctttctggaagcccttgttctgtactgtacatatatcatggcgctgtcctccccggttgtgatttcggatcttgactggttctgactgtcagggtctcgttttcaatataccggggaggatcgttgttctgtttgttctatatagggacgcaggactcaggcagcccaaagaacatatagggctcagccaggctggaagcaagacccagtagtagcagcagcccctaagaagattgccagccgatactaccagctcaaaacgggccacgcagccataggaacctacctgcgaaagattcaggcacaggaaacagaggcatgccagggatgccaggccccaaaagagtcagtttaccatctcctctttgaatgtaggcagtggcggaggcagcgagagaccttatatcaaggtctcactaagactgggattgccagaccaacaatggcagaggcgtatccggaaggaaggctgtttgggaaccccaaagcctcacgagccctgctgcagttcctagcagataccaccataggttgcccccggggggaccaggcacgggcagtggatagggctcatagggatgatgaatgggggctggaggccttagaggaggcagaacgagagggggagggataataggggagggtggcctgcagcaggcaggtgacacccatacagcgataacaccaaggagggcatacataatgcccaaaagccctgcacggtaaggtggtttggggcgaggaaaaggtctagaatggtcaaagataaggttagagactagataggggctgtggcccatgattcggggtctatcatagccgaaaggctcggtatggacgttaaacttgattaataataataatattaccctcaccaatgattacctatactagtatcatagttgtctatccgacgactaagtaccgtccagaatctgagccatctttctctaatcccttgttcaactccaggccgagaaatgaccactactgcacgaatggtcgactaaacattgcttagagattatattttgtgggcttctagaaataagattggtttcagtctcgatcaactgtgactattctctgatacaaaaatgcatatataaaatctcttcatcttgatgaatgagaagaatttctaggtgacctagaggatgcatttccgggaacataagcgagttcaccgtcaatatttttgtctagctcaaatacacaaaagatgattcacaatctggccgtcctcgtacttagcaacccttgctgccctccacatgtttttcaactatcttgccatctctgacaacaaatatgatatccggattggctgcacaggatctcctttgacagtgctccatcacaagctatgtgtctttgcattgcagtagacagcagtctggccgaacatgtgttagtattgcgtgagttaataccacagcttgagctgccagtatcaatgaatggcagtcactgatgttctccattgcccaatgtttgagaattgctggttccctgtggcttgttttgcttcacccactcctccgcatccctgactgcattctctggacatgtcttgtactgcatcaggtacccctggatatctgcaggaggataactttctggtggaattattcgggagaacttctctgcaagttccgctaactgctgatcagaatccttctcgctgcttggcgcaaagttcatgaggaacatgtcctgaatttgactggagcttgcaaggcccatttcgatcttcacatcaacacgtcctttccgagtaagagccgggtccagccgttccgggtggtttgttgtcataatcactattctagcctcaggagcgccgattccgtcgatcacattcaacaggcacgagagggatattctgcttccttctcttgggttgtcaccctccctctgtcctgactcttcccttgatatgccagcggcatcgatgtcttctaggagtaaaatagatcctggacgagtctttgccgaaagtctcatgaagtcgttttcactgagactttcatctttcaacgacacgcggtagatgcaaagattgaaatgcgttgcagtggctgcgaccaaagaggttttccctgttccaggcgggcccgaaaagagaaatcccatacggtatggaatacatctttcagtataccacttaagggaatctggagcaaagaattcttccagactcttgagaaatttttcccgatcatcaatcttcattaccaccgtgttcagcctccgagccgggaccaagttcacttccacccatggtggaaggtgagaccactttcgttcctccttgggccgtggactgtatattgggacaaagcttttaatgctagaagcatattcgcgttcagcttcctccaagaggtttattatcggttgtcgtgacggccagaggacgaccacagtcaggcttgatgactcctgactggtctcaccatccatatctttccgatacagatagaaaacatggcctcggtgccaaaacaggcgagactttgtgtgaggttggaatttaaactttgtgttcttgtctggacggccatagtcgaaatcccacgttgcagaagatgacccctgcaagcggccatcatggaggctgtcgacatttttttccatccacttcgataaatgcttgtatgaatcatcggttccatcaatttcgaccgaggtcatcagatacctgcgtaaagagaggatccaagagattttgcccgaaaaagcacctaagattcctagagcccagagcaatgtttttagatcgagggaagcaatgtgccggtgcaaaccggctactgtataacgaccaactttcataatttttgtcgagaaggatgactttgtctaaaagtttagtggcggtcctaggctagattaagggctttggaagaaaaagtggtgaacaacagaatatcaagctgagcttgctggtgatgttttcgcgcatatgcttgttgattacttaaagattggcaaagcctagagatttttagcctggaagaaacctgtccctggatttatggagctttggagcctgggccctgttgtagagacatggcaagacgaccccagcttcatagattggacaccagttttgaggggtcccaacagattatgcacactagtgacctaaaacttgaactgagaggcttagaggagaggcagataacattgtcagggatggcacatcagatgggagtcccacctgcttaaccagggtataatgcattgggtgttgatcaagtagtcaacgaacaaggtttctgaaagcagcttcccggcggtctgttacatttccgctaatggccccagggcgcattagtgccgtttattttaaataatggtcatagaaggcgtcagcggggctcacatagctcatgctcagggaacgcccatgtacccggagatgtacatacggaaccatcgtgtcccgatacaggctcgagttgcactgctccgactggggtggagttgacaccggcaagttctcctgcaggactgcaggccaatgtcatcaatgggaggctattagctgtttgttggataactctcaaaaattgaagatagctacagccgttatttcattttccactacatagagatgcagagaaatttcccgcatgaccctgctgacaggtgctaataaaaagattctgacagcattgcattagtctttatagctggaggacttataatatgacgaatgtatactatgattcctttagctgactttctggtttcgttcagttcatcaattggatcatagatgacaggatgtaagactgcaaaaacactctacgggtttttgtgcatgtagatttggcctatcagaactgacgaaaatatcgcaaacagatatatgacttggtaacttcttatgtacccgccatgggggtgtcgtttgatgataatgcttcaggcctcgacagaccctccagcgggttgtgttctcgggctgcgttgtcgagttcgtacgcgaacagtgtgggcgagaacaccttctgttcggaatcatacctgatccagcgtttgaactgggacgaacttttaatatggacattgacactggcagcagattcaaaacttacacttgcaatgcgcactcctagccacaaacaccgacgagtgcgggacaccaccaccgacggcagctcgatcgatcgttcctctttgtctgccatcacatcgaagaagtgttccgggtagtaaagttgactccacgcctggccgcggatcaagaaatcctccggcaactgcctggacgatccagtctcgtcgctcgggaactgctcgtcctcaaccttggacatgtccatatcaggctgcaccaatgtatcaagaaacgaagcaatctgcacccagggaacatccgcttcaatgtaagtcatgctcgtcgggaccaacgccatactccaaagaaaagccaacgacagatgcacacttgggagcacattcttatcgccaatgcgtccaagaataattcgtaacgtggaggatgccagatgtgaggcaaaggagagcacctgaatagagctgctgaactggtcatcttctgatcttggcccatcccgctgagagagcacatcctgctcgagagacaaatggctttcccagaatctccgggaagactcaaatcgcgcttgagatggagtctcttggagaacctccgggtcaagcatgcgtgggataatggcgtcagactggccaaagtcgaagattgccgcataatttgacgaggcgatgtaaactccttgttcgcggaagacagcgcctatccggcccatgtatttatctaaactagacagaaactgatccgcagagagaagaaacgagttgattttgcctcttgtgaaaagaaagccatgggcgcagacaaatgcggtcagaagaggggggtagcgaccgctcaccggcctcgcaggatccaaaagcgggttgaaaaggagaagaatgctctcccgggtactcaagaaaggctgaatgctgatcaaagactttgagtagtagaagagttcttggaggaaataaggccttgccagaatcgccaagtgatgctggatccgaccaattccggggttcttatcggccaccttattataccaatatcgagccactccagaccagacttcgcgatgccgcatattgtttccttcgatggccatccggtatcgggctagatcgcccaggcactccatccacatcgcttcgtgcgaaggcacactttccagaagtaacgttatcatggggtaggcgatgtggatgaagttgagcatatggtctagccagccgggaagttgattgcggagcagctccaggaacgaatggatgccatatcgccacatacgagcgggcatggcatacttctccgctaatttcctcagcactgtgctggcggctgggtgattggaggcgaggaagaagtcatgatgctcgtgaagcaatgttcgatgcagggcaatcagcgcttgccattgggcattggtcaactcctccttgctctcgactgctggcgatcgatctcgatgcttcctgagcatggtgctggcggcagggtggattcgaggcgaggaagaagtcatgatgctcgtggagcaatgttcgatgcagggcaatcagcgcttgccattgggcattggtcaactcctctttgctctccgactgctggcgatcgatctcgatgcatttcttctccaccatcaccaagccagcgtagatgccacggacctcgttcacgagctgctcctcggtgatcgggtgggtttcgggctgcagacacatgccggtgggcacgacgtcggccgggttcgcggtgttctcaggggctcgattcgattcctgcgacggctccatggtggcaatggcagcaggcgacttgaaattgtcgcccagcgctggtgcggatttagggaaaacgcccgcagaagatttgcgcaagtcctggcgggggtcactattgcgccggtctagcgtgctgggggatttctttcggcgttcacggctgatgcggtgccgctgcacactcccgctgggggatactcttccggtcttctcagcccgcagaccgcctctcccgtgcaggttgaggctttcgagacgcggcgcatcgggagaagcagctcccgcagagcgcggtctttgagcaggggcaacggctccagcatgattcaggaccgatgactcggagggggatcgttcaatggccgggaaaccgctgctgagtaatgctcgacggttagacagacgcacacaccgcaggagggggggtgaaggagtcagcgctcacattgggttattcacatttgcaggttcatgcttactgtcagtatgatgatgatgatgagagctgggatgactctggtgcccgctgctgtcgctcgtcattgacccggagccggcactggccgccggcgacgcgggggcgcgtgtgccgctttttatacgccgtcgtcgcgaggagagcggtcggttgctgctgcggtcgctcatcgtcacgaagcgctgtatcggcctggatccgcgggtcagcacatggtgtcaggtgacacgcaaaaaagagagtcgaatcgcttacaagacaagtcctgcatgcacacattccattcacgccagttgctggttcggaatgcctcccgcggggtttcgccacctagtcgggcttctttgatcggatgtggcatgcttgccaatccgccattgcaaccaatttatattccatcctcagcaggtggcggaccacggtgcggctcttaagtgaaggcagcgactatcttcgccaacgcaaggctatgaagcacagtgattttttagtggcgtgccctgttaacaccccccacaacgacagccttgaatctcggatcgtcagagtgtacccgtgtaattcaattacttgtaattgagacatcgatacctggccccagacaagcatactccgtattgatttcctttgatctcggctgacttcatgtttttttccttctataaagtcatgccattctcatccttaaatactctacacctccatccaaattatggttggttttttactgctgtcttcgtcagctgtacagtactgcgtacaaagtcaacagcactttgcaaatgcaatcctgctgatattgcatcatcgtcagagacaccactacaagaggtctttcttgctgatgggatcgagaatgcggagactgcgggtgatctcctgatcataccgttcgaacgaaccatcgacatggttcaaaagaagcgtttgtgcacgagcaaacccacaccgcttcaaggtcagtgctttatttaccaagcttgtttcgtgcagaccgcttattgccttcatcggctcgaaaagcatgaaaaatctggatatgccctccaggactctcgccttgtaccagcattgtcgcatttttctgttccgaaatactctgcaagatgcttctgtttgcctgggtaaggctggctagagcactggttgcgacttcaagaatcaatccattgctgtgtcggagaccgacttgtcccactgtgggcaaaaaaattaggatcccgccgcaagttggggtcatgcaggctgcagcagtcatgctgaacgacaccagactcagagcagcctgctgaaggcagccggtcagatggagatctccgggcaaaatggcccctctttcaatcccgggaatgctgtgaaaagacgccaaggagcctgtcagatctccgtaggatttaaatagtctcaaagacggtctggctgcctaggctcggcgacaaatagcgtcacacacaaaatcgttttgagagagacagtctggttaggcgctccaaggatcaccctgttaagatttcgagatatggaagcattcttccccggcagactgacatgcactagctcgtttctggacatgaatcaggcaataataaccccgagtcagttcagtgcccgacggacggcaaacgaaaatagagtggcaaattttacgtcgagggctctcgcccaggcaaggcctcagattatctatattggtcgaaactgagtccaaaactccgctcgttctccgtacatgtgcaccgccgggtgttgacgtgtctgctgaactgactgcattcgcaaaggagtcctatctaggtaatgaccgtcatgctatgcttctagctactaataatatcaggaaacgagaacgaatccactcagtctttcgcctcacacatgctgagactcttatcacactagtctggacatatcgacgtcattttttttccagtccaggaagctcagtggcaatcaatgatattgaatgtttgattggttggtgtttcgcttcattctgaagctgtagctcattcgtctaaagagtgtggatgtgaaacacctttcgtcgccataattttttttctttcgttcgtttttcctgtatacatagctactccgtagattatccaagaagaaaaaaaaaaagaaaaaaactgtttcctgctttgaataaactgtactgtagaacggactgccagacgactgccaaacgcatacacacgtgatctcagtttcgtcgtgaaagcaacaatctataagaagcaaaataaaataaaacaaacaaataagtgagtaaataaaatttatttaattcctactgaccacgacaatgcccccttttcgccgtgcctgcaattcgaattccatccaatcggttgaacccctgttaagctttctacatactccgtatatatcatatctgtattaggctactgtagatgaaaccctcccttccatatctgtctgtctcattgtttcacagttgaagcgatacaaaacagcatgtttcaccctttgttgtacgtctcacagcagggaggacagaaaaaaaaataaaatctcatgaaactgacctgaaggctagatagctgtgtgtttgtgtcactgtacagtaccccggatctacagcgcagtgcaatgtagtacatacggagtagtacatatatagtagctttggataatctgtacagtaccttgtgagacacctcatattaagatatttcgtctcatatatatatgcctaaaaaggaagatttctagaatccttctagaacctttccagaagatcttgttttctagttaaaacaaacagcgagttgatcgaattgattgtgtcgggaaaatatttcctctctgtctttcgtcaatctacggagtaggtacggagtacatatctatgtactgtacgtacgcttatccgggtacgtacggacggtaataattgtactgtactgtacagggtatagaatacagacagacgccggtatctgacccctgaacggttgttttttgtacgaatcgaatcgagtcgagccgagtcaagaagcgagataagcgattcgagctgcatggacaacatcggtagcttgcatgcataaaatgataaatataaaatcagactacatggactatatatagcctaggatctcattctttgttcaattcaagtcagtcttcaggtaagacagcccccctccctcactcaaggatggaaatcctgatggatgggagaccttgtgactatggtataatacgacgatacaacagtacaatccctgtacgtaatttgtttcatgtattgttatcatgtgtgtcatgcgactaaaccccgtgcatcagcacagctgctcaggggggatggggcatctatcagctattggttgctgccgaaatatcccagagcttatcaagggtataatccatctgacattatgccctgtcaggcgtcctatcgtaggtaagcatcaggagagaaacttgttgccttgtgaaccgggtcctttactatatgtatgtgcggatggtaggaagcaagggcacttaataattactctcctcttttaccttcagcatgaccggtctcatccagcctgattgtaaagcctcgacatcattatatctcctgctaagaactgggattgcggtggaatggaaacgtcggaactgctctttgtctcttctccgtttcgctaatgtcaaaggacagggattagcatcaccctgggcggggatatagatattactttagtcttggactatacgtatgcactgcacataaagcccagtccggcccagttaggaacagcatgcgatttttgattcttcatgcgatccagtgggtcaatcctgccaggagcaattgtaaggagagatattacggagtaactcccatgtctagccctagttttaatctagcgaattatccaaaataggataaagcaggtacgtcaggcaaagttcagcagcgcctcgttcaagcagacggataccgtcctgttattggtaccttttatcactgtctcagacaatggcgcttcagcctttcctagtaccagcatccaattgacgagagaaatagctttaaattctacgtttcaacttaaaaaagatcaagggctctagaataaggcagagcaaggcgaaaagacaaggcagtggatataacagtcctgtttctttttcgcagccttgctgtaggggcatttcaaggcaggattgtatacagtacaacatctcacagaggtaataactcgatgctaatcatgtacatacagtacagtacatacaggacgcacatacttcggccgtttgctacatgtacacccgaacatacgccgaaaacgcagatcagtggcatctgaatgaggcaaccagaaggggagattcggccataatgagaactgaagtgatcgacagtggcacaggttgacagatggcaaagcaggtaaacccacttggaggtcgcgaccacctagctgattaattattagtactcggtacagtacggagtactctatagtctatacggagtgctccacagcagtgtcatcttagggctgagaatagtgattggattctgcctgggaagaatttagccgaagttctctaacgggcgctatctattcatgcaggttgccatgttgcatcggattgcaccgttcatacctttaacgtaatcaaccaccgagcgacgaataccaccgagcgacgaattttcctccaccctaccacttccttttttcaacgcgtcattttatcaccaccactatcaaaaatgcctttatctcaagaaaaccgaattcaaatggctattgcagcttataaaaatcaaaaagtcaaatcaatactgaaggctgcagagatttttggggtgcctgaggctacccttcgcgctcgccttaaaggaagacaaccacgcgcagaaacacgtgctaatggccatagattaaaggctattgaagaggaaacacttattcagcgattactagaggcagataaacgaggttttccaattcggcctagagtttctgcgttcaatggcacaagttgaaaataatanagggactaaaatttgcgggttgtaggagggaggcaaggaccaagccacacgtggctgaaaatagccacgtaaagccacaaggacaagaaatgcaactacctacgttttcaaggttggaaaatggaggtgactttaaataaagactctggaggagcctttaataggacaaggttacaaatagccttctatttgcacgccgcgctgaaggacgcttggtgacgacattaatagcggggctcgaatttgcctagtcaggcagcgacgtcaggcggagatgtcacaacaacagcaaccagtttccagctagcgaccggaagacgtggtcacgtgcaagcagacatgtccatccagaccaggtttgctgtcccctaggttctcaatacccaacaatgagggatctgaaccgcgcacgggacatgttttgtcgagagagttgggagaatatgtgtcgtctttaggcgaatacctggaattcgacctggaatccaaccgcgacagtcggaagtgaggaaagccctgtttcgccccgccccacagttaacctcacgtaggtctttctttactagacaatttactgcttgctgactggtcatataacacagatacagccagtgacgatgttgtgaaataatagttacaagggtgcaatttctcggtgattttggagccttgagaccgactgcacatatggtcaaggccatagagacatgtcttagatgctacttggttatggcctatgacttgatatgagaatagccagcagaagaagagatatggaagcaggaatgtgctcatactgaaactatttactgtgttcatgttgctgacccctattagcgtgatactagatgctcgcctcagttttactgttgtcaaaggagttgcaattaccttggcttttgcgagcaaagaggaattgacgaggtgggcaaaactaaaactgccagattcctcagaactgagaaagaagtgtgaggttattagtgaatggtttaacctcttccaaagtactattcaacaatatggcattcttgaagacgatatctataatggatgaaacggggtttgcaatgggcctaatttctactacacgggtagttactaggtcagagacattgggtcgtccgcctcttctacagcctgggaatcgagaatgggtgacagctatcgaatcagtcaactcagctggatgggctctaccaccatgcatcatttttaaagggaagactcatctagaggcctggtacgaggatgattctttaccgcgtgattggagaatcgagattagccccaatgggtggactacagacgagattggtctctcatggcttcaaaatctctttattccatatacgaatacccggacaaagggtagatatcggctattagttcttgacggccatggaagccatgtgactcctcagtttgatcgtgcctgcgctgagaataatattataccgatttgtatgccagctcatttgtctcatctcttacaacctctcgatgtcggctgttttgcagttttaaagcgcgtatatggccgcctaattgaagatagtatgcgactcggcatcaaccatattgacaagctagatttccttgccgcctatccaaaagctcgcatggaggccttcaaattcgataatatcaagaatggctttgcagcaaccggactactaccatttaacccggagcgggtccttacacagcttaatatacagcttaagaccccgacacctcctggaagccgtgccgggagcactcttaccaattgggtgccagagacacctcataatattatcgaattacaccatcaggcagctacaatcaaggccttattaaaacgacgcacgcagagccccccgagccctacagacgcagctttaaatcaacttatcaagggctgtcaattggccatgaatagtgccgtcattcttgcaaaggaaaaccaggatctacgagctgcaaatgagaatctgaagcgaaagcgcaagcgatcaaccaatcagatatctcatataggggttctttcggttcaggaagctcaggatcttatccaaggtcaaatttcaggtgaaaatcagatgccgcagggtatggccactccggccgcggaagcggcttccacgcctcgcaggcgcgcgccgccgaagtgtactaattgtggtactattgggcatatacggactcgatgctcaaatcgctctaatccatgatttttgtatataactggcgttttaggtggataatacagcttcaaattctatttagtagttgcgggcgcgggcggtgatcggctcgcttgtggattacgttaattgaatccgctcgggcgtcgtgccgcgcccaggactcagtacccgtgccaagcccacccaacaccacctggtattggtgttgggtgggcttggcacgggtaccatagcgcgttcagagttagtggctgccaagcattttagccccatcgtgatacatcagctggactcttcagtcaacctcgacgttgcgtttataatctctagtaatcagtgcatctgcttgcggcctttctttgagaatgactcgagcctggcgatatgcccgcggcatttttgtgtttcgtgacaatttaaaaatccattcctgcccgcccgtgaggtcgtgctttcgccttcaactaagttctcaatcgccacctttctcgaacactaatcgcagaacaatgtcgtcatctttgggagtgcctcatgccctacggtcgtttccaagctctggcttttgagttgattgatcactctgaaaagattgaagaggagacactacctacttaccacgccgaaaagattattagcttattatagttttttaataaggttagtattataaaagaggtagaggattaataagaataaagatccttaagggatacttatattaattaagaatttatttatctctttttaggttataattatatagccttagaggaaactattagtctaacctattatttataaaaggatcttccttttttatgttatataatagataggtataagaaatattattaaagatacctaaaatattaaaggttagtaaggatattattaggtatcttaatttttataatatatatcctttttaataagatataaatcatatacttataagcttaggctctcctattatttatataatgattaaagaaaagataatattttttattaaatttattaattaattagctatagttattttaagaatcttattaagtatattaaataatataataagcttatataacttaggatctatatagttatttttattaagtttttaaaggataactatagtagatttacaaaaataaataaatattaatatcttaaataagtattaaaaagatttattagctatttatttaataataaggttaacttttgaatattaggtttaatattttattaggccccaatactttataaaggatagtattttttataatattcttaacctaaataattttagactaggattaggtctaaatattaatagcttataataatttttaaaattagccttaaaaggtagaagaaaaatatttataaaaaaggtatacctttctatttaatatattaattttattaccttccttattaataagagtaagtataaatataaattagggtaatccttaattcctagcctattttattagcttttaaaaacctttttatatttaaatagcctctttaaccttttattaatataattaaatagctacttttattattttatagcttagtttgtaatataactatttaaatacctcttagtctttatctacctttataagcttagcttttttttataagcttatctaaccttttaccttagtatcactatcttagggatatatttaaggtataaatagtattaggggtaattacctctactattttagttaatataataattatatacttaattgtcttattaatatttataaggttattaatttagtaaaggttctaattaaatttccttataatcctaaagaaaatatcctaatttatttatttttatatatatcttataattaaaaacctctttatctttataagtcttagattaaaggttatcttaataaggatatagtctcttttaatagctttctaatctatttatattttataaattattaggtattttaagatctatatataataataccttagactaggttagtagtagtctaataggagttagttctaactatatttattatatataagtatacttaataataggaagaggtattatttttttaattactaggttaactaggtcttttacctctttatatatatatttataccttagtagtaattatattaaatagtaaaaattaaagttcctaaaaataatttattatttattatataatctagtaaaagagtaataagatattattagtacctttaataatattaaagcttaggttatattataaatatatagtcctttattagggactataattatataaaatattaatatattaaaatctcttttatattatatagactgtatttcaaggttaatatctttactaattataaaataaattttaaaggcctttttactccctattatttctatatctctaaaggcctaatataatatagaaatacccctttaaggcttaaatataaataatattctttataatatataagttaatctagggctcctagatagtaaacatatattctttacctcctccttactaaaaaggtaggttataacttttgtcttagatttctagtagtttacttaaaatatctttaaataattataataaattagttctattattatttattattttatagtctataattatattaaaggattatatatatattaaggctatttaatttatctttattattagattactcttaagagtaatttaagctcatatttttttaatatttttataatttttagtatatttatagtaattagttttaaaagggctttaagattattaaggctataaaaataaataatataaggataactagttaagaactaaaaaggccttacttatatctttaattataaatattactatattaaatttaattaatagtttaatatttataggtttatttttaatagcttatataataatatctacctctcttaataagtatcttttagttaatactttatatctaaataagttattctctcttataatatatatctacccttcttaatttagtaatatcttaagttattataatttaaaggttaataatactctaaggcttataatattttattaatctccttttaatctttattagctttattttttttaggtttatttttaaattaagtatattttctagtactattattagtaggcttataaattaaagggctagtatctttaaagcctaggctcattagtattaagtctttattaggatttataataattatattttttattatacctttttaggtagtatttttaaggttattttaaggtttaataagctaatattagagtcttttaaccttaataaatcttttaaattgtctccttatattttttatattttaattaaaagaatagtaccttaatttcctatatataatatacttagccttagctatatctactttattagggtagttatatatattatatagctttatataataagtatatacttaggttcttttatagtatactaaaatatatttatataactaatatttaaagtattattaaaactactatttttagttatataaagtatataggtagctttttatattaaatcttagtcttaaataaataactatatttactatatatctattattaaaatttataataaatattaaaatctattatcaataagctttcttatacctaataactatcctacctagataatattagtatgtttatatataattattagtttttaatagtttattatcaagatcttcttaattagggcttactaattaaaagtatctatccttatattaacctttatatattattatattaatctttaaatcaaagataatttcttaatgaaaggcttcagcctatatatttaatttaataagtctttttatacctttaaataagtctataattaggattatattattattatttagaatttatttagctaaaaccttttaaaaagatattattggatctctagattccttaatagctatatttataatatatatatatatattacctagtttcctctaaaggggattaattatacttagattaattttatataaagcttaaaagttttatggaaggttaaggtaatattataatccttaagttttttactctaatataaaagactaaaaagatattataatatttatttaagttatagttttaaggtaagatattagggggcttataagttttaattagcttattatagatattaagataacatattagatattagttttaatattaataattaccttattaatctatatctacttctttataaatacttatagggaggatttaatattttatagttttttttaagcttacaattagataatttattttctatttttttagctaagttaaatatagatttaatagcttttaagatatttaatagtaataaatttttagtctctttagtaataaccttaagctattcaacttcttatagaaagctaactatataggttaatagtcctattagtcttttaaactagctctagctatttctttaatttattacctattatattaatttattattagccttaataaaaaggggtagagttatatactagtaggtaaagaagtaaaaaaatatatttcctactatataaaagaaaatatattttgtttcttatatagaagtcatcaattttgtgtcagcgttggatgtgttattaaatttgtatttagttgaagatataaaaaaagatagttactttattatctagatataagcatatactagattagacttgagtattttaaaaaaattttatagattagcccaattaagtatagttaaagggttagtattatataattaggtactaacctaattaggtataataagtaaaagttgagtgtacctagacactaatttagtttggtttattttaattagttctgaaattgctctagatgattagagcttttttctggccactctgagctgtaagcaccttttctttaaatattactttaaaaggcatttattatataatattactttatagtactaattagctatccccttggctggtgagaaaggtggtcaaattagcgccttggcagcggcaatggacttcattggtttatttattcaccgctttctagaaatccggcagaaaacaccacggataccaaaaggggaatattagtgcgaaggcagtaggtacagttggccaattaggtggccgctgcaaaggcgctaatttgaccacctttctcaccagccaaggggatacctttaataatattttataaaattataaaaatatttaataatgtaaaattataaaaaatagaattaaggataaataacttgttttcttaaaagctactattaataatactaatatgtatactagctattagattcttaataaccttaaggaatatcttaccttattaataatatttttaaaataaatctagtctcctacttatattatattaacctaatattatattatttttataaaaaagaataatatatattatatataacttaaatatcagggataaaaataatattattataaataaaaaggtttaattagctctttaattttatttaaaagttatatagctaaaaggtttctttattaatacatatcttatattaatattatttctcttactatccccttagctattaacaaaatattcaaattagcactgtcagtagtagctcttattggttaaagcctttactactttgaaggtgctgtctatattattggtcaaagtgcctggtatatatggattctgctggctttaacaaaagttacaagtggtaaggatatggagcaataataacatcaagtgccgaggcgctaatttgaacattttgttagcagctaaggggatactctattcatatatagatatctaattaacttagagatagtatttactaaatatttaggctctaaccttatattagaagcctcttaatttctatatagctttactataatactcatattaatatgattatatagatagagcagggttactcttatttttctgaataaggggataatattatactattctaatattctgcccttctttactgcctatagtatatctttatactaccttaggtagttctatagtcagtttgataattaatcatactattattatcaagtcattatataatctgtgtagttcatgctacggcagaattgccatgtttcttttactgctctttatactgcctatgtaaacctatctcccaaaacatgcatctaagccatctgcctgcaagctgtcacaattattattaaacaataaaaatattattactgccttataaattatatttaaaaggcttgaagtagctagtttttgtaagtgataatttttagtaataaattatagttttaccaaataattaacaaaatataagattactaatttaactaaatatataattattaggctaaataaatactattttatttttaatattattaagtaccatatttaagtagccttaatatttactttaattttatagactttaataatataataatactctaaaaagttatataaacttaaaaaataaaaagagacataaaagttaataaaactagtagttttaatagcttttagtaagtaataaggtactaaaagtaaatatctgcttaatataagaatcctaagtataccagcaaaattaaaaaatagttaaaaaatataacttttaaaaccttaaataacaaggatttttagcttaacttaaaaaagattagttatttactttaagtaataatttttaagtagtaaaatactaattaagtaaattcttaatttattttattataaagatttattactataaaaggcctatagctaattataaattttaaatatggcttttttagccatataaataataatattttataatataccttaaagtaataaagaattttatgcctactatatagtataagatatattaggaaattcctatttactaagatttcttagcaggattttctaaatcttatagtactttaataggaaaactttataaaataaggaaatcctttgggctagtttgttttactctaggatttcttataagaaatttttagctacctaagaaatccttataggaaattctaattaattatttgtcttattctaaaatcctgtcctgtcctaacttgggaatgaatttccctgtcagccaccctaactgtagtttggcacctgcaagctctggtaaggtatcttaataactacctttagttgggctgaacttttttctcgttgggttaaagtataaacccccttttaggccatgaagctatataatagtatcctgattttgctggttaagacttacatgagggtaatgctaaacccacaaaggttatcttttacaacaccgtactggatcaagggggtttttagaaacggtcatttaaccgttatttaaggtcaaataactattttattatgggaaatattagaattatgctaaaatggctatataacagttattctacagttagtgattaagtaacattaatttttttaaaaaaatataagtcttagaaacattaatttataagaaaaggtcaatttatagaaatagtttttccaaaatgcggcttttacatgtagctccctgccacaacttcagaatttagatagtttagatagtctagaaattggagcttatctccttcctatatgtaaatctcatggcatagcttagtagattatgatcgtagttcgagtcatatcctgggcagagaaaaaagatgaagcctttatttttaattaatggttaattctctctaacgttatttttttagcaacaatcagatatgaagaactttttttttaaaaaaaaaacctgacatatgactgttgattgactggttctaaaacccccctgatccggtatggcaaatagcttctgctcctaacctgttataattgcacccttctcaagataacagctcgcgcgccactaagatcattgtcatcctgaatgcatggttgccaaatatcgatagcaaaatccctacaatgttccacctgccttgccaaagtttgggccatacataccacacgttgagcctgtgctaggcttccgcactcgaaaatagcaagtcttgtccccaacctgaatgtcagagaaagtagctgcgggtaaaaggcatcttcttgccttatgttcccgacatttaaccttgacaaatttgagagagcagataaaggggggacaagggctagggttggttcatagacacggacactgcgtgcagttgtcccattcttgaagctggaaggagatatgtatggcgggttagagatgagaacatcccaacaaagacttgaactcggaatcgaggatccacttccattgaggtgtcctaataataactggtcacttagaacatcctccagcttgggacagtgtatctcctgaaggcccagtatatctgcttgtctgaacagaacttcacttctagcgcgactggacagtaaaccgcgtctgagattgtgctccaggtttttttgagctagtctgatagctctggaactgagatcaatgccaacgatagtcaaatctttgacatgtggggcaagaagcgcatgcaatagaagagatatgcagccagaaccagtacaaagatccagtatatgtaagggtctggcctgtgtggagtgcttgtatcccatgtcatttaaaatcagatcagcagcatggaatgtgtacagttcggtttcaacactgcatgataaaagggagaggtattagacaaaaccatgcctcacagaaacagcgaggtttgggggaagggaggtggggcaggcatcaagaaaggagagagtgacaaaccgtgggatcaaaaccccttttctgcataagatttccaattctccaaagggctggtcccccaggatatattgcagtggctttcctcttgcccgctgaaagcacatagatctcagctgatttctccattttgtgcctttggcactttgttgttcttgttggttttctctggtacagtggaccctaaggtcattaattgccttctctcgaagccagcgtagttcattttgagcagaatcaagtgaacgacattccttgagtaggacaggcaacagagggtgctgtcggtaagcttgaagaagaagtgatgtaggaatccttggcatggaagggtgaaattaatcgtcaatgtataatagtgtgcagccaaaacctgtatatacaaataatagtaaccctaataaggttacattcttgttatacctaggtttcctcttaactctcttccgcctatgccaagatatgttacctcagttccctcagcccctccaccctactccataggcgctgcactaagtgctcaccgcctacccagtttgtccgctgactcatctttttgggtgtaatgtctaaccaacttagtggcacctaacaacttcttagggattttgcaggtatccctaccaaaacttcttaggagaaatataactaatattatataaaatatttattttaaaagaactaaagcctattttaaaaattaggctttattaagtcctacatattaaaagtacctttttagtatttttaaaaattaaaaaatatgtaagttattagttccaaacaaaatttttattttatattaggaaaaataaaattatttttaaaaaacaaaacctatattaaaaattaggctttaattaaaggtttaatagtgtgagggaaaagactgataccagagatgatgactgaattatctatctgctacagctagatacatgtcatgtatgtcttcccaagggcggtaagatactgttggatgacaaatatatattaaaaaatagatttaaaatatatattaaaaaaaataatttaaaaaaaggttaaatcactggttccaaatatttcttactatatttagataggatgtaacctttgggtaggtaatttaaaatataatacaaataatataaaaatctaattttttttaatttgcccttatactaaaggattacttgataattatattatctgatgaggggattattattattattattcttccatttttagagagcgtttttcagtcagagactatgcacgctctgcctaccacctaggcagtagggcttagtagctagtatctatatacaggtgggttatgctatagaccagtcaacagtgggaaccttctatgagggacagaaatagggaatgagagacaggctgtagtataatgtaagaatcaaatgttaaggaacagtaggtataggtggatttaacaaagaaaagaaatgagagaaagaacagagtaaggctgtatgtacgcagcagatagatggaattgatactaatttatgtcttggtctgatctgatccgatccgatctcaaccgcgataaccggatatcgcgtctggcgctttttcagcagcacatctgggacctttttaccgggggaaggcgaatggagaagcctgacatctgcttgacagtcagtacagggcaagtcaaccaaacaaactacatgatggacacgtaccggtctcgtaacaagccacgtactcatcgttttcgtcttgaattcccttggcgatttggctcaaccagtcgtatatcacactactagcagcctgatgcacagggcctgccgtcttgatgatgatgttttgtaggttcgcatcatattcaatgccgggcgtctcgcacacttcggtctctgaccattgctcgaatttacgaggttcaacctgggtaatgcaattcattccccgttccttagccatgtccctaccccccaactttgatacacggcttcagggcttgcctggaggttttccacgcgaatccttcctgcgagcgttcctcgcagggcaagcactttgtcccgcgtcaggtccttgatggatcggacattggaaagaatgtcgttcacttcttgctgggggtccatgattggtgggtcttggaagcagagatttcgagtcttcgatttccccattcacaagagcaggagcgtgggcttttatagcccttgatacgaaccgtcgcttgatcgaggccgcgggaaaaaatcccgacagacacacggcagaggcaagcaagccgccactgatctgcaatgcaataacgtatttcccggctgtttcgatcacccggttgctccgatcactagaatacccacacaaaatgcgtttttttgtacgctcataccacaatgtctatattatatcctggcctttaattttaaaatcatattatatataggtataactacttgtaagagaaatataaggttaatattatatatattgctttttagatacctattttttaattttacataaaaattacactgtattttatattattccagtaaataatagagtaaacttattattattaatcaagtttaatgtccataccgagcctttcggctatgacagaccccgaatcatgggccacagcccctatccagtctctgaactcatctttgaccattctagacattttcctcgcccaaccaccttactgtgcagggcctttgggcattaagtatgcccggtgatggtggagaagaaatgcatcgagatcgatcgccagcagtcggagagcaaagaggagttgaccaatgcccaatggcaagcgctgattgccctgcatcgaacattgctccacgagcatcatgacttcttcctcgcctcgaatcaccctgccgccagcaccatgctcaggaagttagcggagaagtatgcaatgcccgcgcggatgtggcgatatggcatccattcgttcctggagctgctccgccatcgactccctggatcgctagaccatatgctcacctttatctatatcgcatactcgatgatgacattgctgctagaaagcgtcccttcgtttgaagaaacctggatcgagtgcctgggggatctggcccggtaccggatggccgtcgaagaaaacgacatgcgggatcgcgaagtctggtctggagtggctcgatattggtataataaggcggccgataagaatcccggaattggccggatccaacatcacctggcggtactggcaagaccgaatatcctgcaacaactcttctactattcaaagtccttggtcagcattcagcctttcttaagcacccgggaaagcattcttctccttttcaatccacttttagatcccgcgaggccagtgagcagtcgttatccacctctcttaactgcatttgtgtgtgcccatgggttccttttcacgcggggcaaaatcaacgcatttactatgtccgcgcaccagttcctatcaagtttaggtacatatataggccggattggcgccgtcttccgcgaacagggcgtttatatcgcctcctcgaattatgcggccatcttcgactttgggcagtctgacgccattctcccacgcatgtttgagccaagggcgcttcaagaaattccatcttcttcagcgcgatatgagtctgcccagagattctgggaaagccatacatcatcgtcatctcttgagctgagtgtgctatctcagcgcgatgggccacggtcagaagatgaccggttcagcagctctatccaggttctctctttcgcctcacatctggcattctctacattacgaatcatcttgggacagattggcgataaaaatgtgctccctagtgtgcatctgtcattagcttttctttggagtatggcgttggttccaacaagcatgacttatatcgaagcggatgttccctgggtgcagatcgcatcgtttctcaatacgttaatacggcctgatatggacatgtccaaggttgaagatgagcagttcccgagctacgagaccggctcgtcgaggcagttgccggaagacttcttgatccgcggccaggcgtggagtcagctctactacccggaacacttctttgatgtgacggcagacgaggaggagcgatcgatcgagctgccgtcggtgattgtgccgcgcactcatcggtgcttgtggctaggagtgcgcattgcaagtgtaagtctggacttgttgccagtgtggattatctgtatactgatgagagatgattattatcgtagttcaaatgctggatcacatatgattccgaccggaaggtattcctacccacgccgttcgcgtacgaactcgagaacgccgcccggcaacacaatcccctgcaaggtgtatcaggcgcggaagcatcatcttcatcttcatcccacgacaacgataccaccatgacgggtatgtgatggaggtttttatttttttccctctctctagcgatccatccatatatgggaggttatctgtctctgtctctctttttttcttttttttaatccatgttcaagtaatagattcgaacgatataatataaatatgaaacgatactctcggataggagtgtatgtatgtatgtacattgttgcaagcggaataaataacataaaattttcaaaaatttttctcaattttaaccaatatcttcaatattattgaaaaaacacgctcatcaagtcacgtcacacacagacagaccttgacgagaagagcagtagcagcacagcacagcacacactcttctccgttcaggattcgtaaagaaaataacaactcccgtacttatatagtgtctctagtcatgatggatcatgtatgcctcaatgcctcaatgcctcaatgacaatgacaatgacgatgacgatgatgacgaacggcatagttccaatttcatttcatcttgcattttatagtatgtatagtgtagtctgtgcagtacgcttctcttgattcgcctcatctgtcatatcatcaacgtcagcagcagtagtggtagtagcagtggcattaattcaacatgagcattaataattttttttagaaaaaaaaaagaaagcaaacaaaaggtgaccttccctcgttctttctatctatttcaattcagttcaatttattcccccattgtttttcatctatatgacgacgacgatgatgatgatggagtttatctgacctgacctgatctggtctggtttgatctgatctgatgtgcattgcattaccttgccttggcttgaattgaattgtacttgattcagttcgattcagttcacttcacttctgttctattttacttaactggagagatctaagatagagtacagaatgcaggatgcaggatgtccttcttaatgtacacatagtggtagatattcatgctatttatttattcctcagctagtcagtccaaatactggaattctttttcattctttgcattgataatgaatgctctttatgcttcttgctagctagacctttcttttcacgctgtacagatagacaaacagatagacatccgtccatggtatgcaatttcgattcgattcgtttcatttcatttcgtttcaaagaagaagaagaaaagcaatgtcccatactcccgtgttccatattgctgtcatcatcgtcattgtcatctcatattcgaagaggaaagaattgagtactcaggcatcgtatttctcgttcattcagttcagttcatgtcgatttgatttgccaacgtcgtaacttgtactcagccgtagcactgctcagccgcagctcatgtgtatcctcgtggtcatagttcccagactctcgaatacgtgatgtggatagccgtcgataagctgtatctcgcaggttgaggaactacctagttgaggtagatgcgccactggagacggtgttagctagctcagtcatacaaaacatgtcaggacacgctatgctgcttaccgcctgtcgaacaggcctccgacacatcgggcaggtcgcagctgccttggagcgagactgcgtctgcgcaatgctagggccgttgccgttgccggtgctgcgcagcgtcggcagagcctgttccgcacaccaccggcagagaatcgcatgcccgcacggcagcagcaccgtgtctaccagctgactcatgcagatcttgcattcgagattcacctgcatctcctccgcttccttgggctcgggtcgtttggtacgcgggtcgtccagccccaggccctggctccggggcgtgggcatcggatcccccgcagcagtggagttgttattagtggtattatttacattgccagaccttctaccgctagaacttgcaccagcacttgcaccggcactggcaccgtgagagattgagacggtagtaggctgctgctcgttcagcatctgcatggcctcagcggcagcatgttcagcgcgaaggtggctgttgttgctgttgcgcactgcgccctgcggacgatagctgccttggagagtgccagcggaggcagcaggagcaggcacgttggaacgaagcggttcagtgagcaccggaggaaaaggcgggaggtcatttgctgaaagcaccatgccgggaacagaatagtaacgtcctgatccttcgaatcgaggcggagatggacgacgtgcaaggttgttcggaccctggtcgtccggacggcgggcgcgacgacgactgttgtgctggggctggctctgggtctgaccagcagcattattctgcggtgccggaccgttgagactgggaccaagaccatccgacccaagtccaagactaagaccaagacccgggtgatgctgctgtcgctggtagcccaacgcagatgcagctccaccggggtgaatcacgtatggatgagcggggaatcgcggctggtggacttgggaaagcgcattggcagcgacgatatccggcacatgctgagcctgcatctgacccgagaagctgagcggggccgcagacgacatgacgggaaatgcagggagaaaggccggggccaaaccggacgcagcagctcctggttgcacctgtctagttggatgctgcacacgagctgggcgttgcagaccgctcgcgtacagggccgccgttccagctgctccaaatccctgaggaacacgcatggaggcgatctgagggtcaaggagccagggctggtgcgagccatcaccaggccagacctgatcaaactccatgggagtggccatcgtggtgcgcaatgcggtagctcctacattggcattgccattgaggccggcattgacattgacgtgaccagccggttcggtgacgaaacctggaatagagacggccaccaacggtagctgaggtagatgtagaggcatctgctgattgtgtatctgctgagtctgcatcggctgagacccaagattgcttctggaatcgacaccaggggtggccatcgggtgagtatcagtattcatgttctctgtttgatagtcagcaatgattcaagtcaggaatatggcttccatacgcgagactgcagactggtcgacgttgccttgaagctgcggcggtggatcttcaaggttaatcaaatcgcccatctggttcggaccagggagtgcctggctgtcaacaagcgttggcatgttgccgttctgagaggtcgagggatcgcgtatcacgtcagggcggttctccattgatctctgatggtgatagggcactcgagatactggaaattcccgcctcagatcgtggagggtcgagagaacacgagagatatcagtgttgattgcttccagctcgtgcctcaaggtggtgatgttacggcaatggagagaaagagaagaacgaggctgaacacgcggacgggtatgattctggtagctgttgcgattcctgacagcgcggtaggcttcgatctcagcagtcgtctctgggagattaaacgcagccacggacgactgcaggacctggctgatggggatctcaggaacagaattgccggaatgcgcccgccagtattctagatatggataaatgagcgcatgggacaaagctgaagaaagcaagaaagaatgaagcacaaaggaattgttcaaaaacagtatctcttaggatgtgattctgatgccaattccaaacataaaacgaaagctgtacactgcacaacagactcagggatactaaccctggcacgacctgcagtatttggaggaattgaagctcagcacggggttgagatggctgtcgccgtgagcaagccccggcagaagctcagacacgcttctgcggtcggcacagcgacagcagatggacgagttcaccaggagacacccaatagcatgacgatgcacacaactcaatgcttcaggccgcacagacagactggacatgatggtgagagaccagagagaagaggtttgctctgcttcactgggtatttcaatgtcctgcccaccgctttgtcttcacggtgcctgtccagcagtgcttacaaccatgttgctagtcgacgctcttggatttcagtgaagcgacagacagataaaactcccgcagtgcttcagtcactctccaccatcatcgatctaatatcacgggacggatcttgtgatgcgcggattgcctgatcggtcagtctgctgattgtcaagtcatccaccgtcagagcccagacaagcgagctgccgcaagagagcttttttcaacacttccaggcagcactcctggactaggttgacagcgctgaagcctggccaccgtcgagcaggaagcagagatggacgcggagagagggctgacgtccgaacaacgtttgcgggaccagtggccggacagcggttccagacatgatgcagacctgctggcctgtcgcagagggcatgataggctggccgagttacaggctggactaacccgcagccgccacgcgggcacctgaggcgcaaggccgatagtagcgatggcactgctcatcgagtcctcaggctgcgtcgctgatcgttccgcgtcaaaccccgcagaggggaagcccgcagccacaggggatcgagttcaggcgtgcagctgcgcagtgttcacacgcacccggcagcaatggacgtcatcgacgccgtttggatcgatcgatatcgtctggcagctgggattctgactggccgagaaagcccgaccgggagtcgtgctgccagttgcagtaagttgcattccagacgagaggcgacgtcatgcccgattacgtactcgtccacaccggaattatctcgatcagctggcccctgcgtcccgagcttgacgatcccgatcggtatggagatatctacaaggaatgtcacaggtctcgtaaccaaccaaatccgtacgattcaatattcatttagtccactgcgtcgaaagccaaataataatgactgatcacaagtgacccagcacaggaaaactttctcttgatcctgtcacgtggtacggaaccaacagacatgtccgcacccgcgtaatttagacaacagtattaattaaaactaactatgattgcattttattctttgttgttgtttattaaatggttcaaaataaaatagttgaaagaaatgcccgtagatatagtgcccggaaggaagccaattagcgtggtcgacatacgtcagtacccgcacgacatctggatactttctccgcattaacatctgctcttcagctcaacgattacagcgggaataacaagccaagagtaggggaaaagaagcacttgaaccaatgcagattatcatgccatctttctagctagactccgtatatactattcatgacatcgagattgctgctgaccccccgccatctgtatctgcgtctgcatctgaagtccaaaccaaagacgagctttatcaaccgcaccatggtgaccttcaccatcccctccagcggggacgcagtcgatgccggcgaactgaccgtcaattcgacgcctgaaaatctctcacgcgagcagctgctggctttccccgcgttcaagatctggctctcgacgctgcagcgctcgttggcccggcagaagaacccctcgcacgagttccacaagaacccctatgtactgcgcgggatcgagattcaggccgtcgatttctttcgtggtggaagactcgggttcgtcaagttgagggcggacgtgtcgaatcaggatggggagagtctgccggggagtgtgttccttcgaggggggagtgttgggatattggtaagttatatcttcgtttttttcttaaaagtacaactggttcaaggtcctggttggggtggacaagcaagcacgcagacaggcatgcaaacaaacaaacaaacacgtgccatatgtgtctctatcagcatgaacctagcaccaaacctggggccagtggcccagtcgttaaggtcaggatgagacaaattctctagccttggtgtcactgggcaggcctcggggtcgatccgccgtcttgtcgatggaagactcaatttctgctgacatcagtcaagattggaggatcagtaaaactctgcccgtcgaaagacgcagtctaacgacgcagtggggttttcgtagcgcccttcctcctcgcaagaggaccgagggtgtgagcttttttatatctcaatttttttttgtttctacctgtatatttctttttcttttgcatggatcgatgttatatacagaggcgaacctcacaagttctatatcactaattgcatgacttatccctaactgacaacttttttaccagctcatcctccaaccagacgatacacctccatcctcagacgaaggcaaacacgtcatcttgaccgtccaaccgcgcatcccagccggttcgctcgccttcccagaaatccccgcagggatgctcgacgacagcgggacattcgcgggcagcgcggcgaaagaaatccaagaggagacgggactctcaatcgcgcaagacgagctcatcgacatgacctctctagctctgacgtcacttcagagcgaccaacccaaaaccaaaacccaaacgcagcaagatgacaacaacgacgacgaagaaaccctccaaaaagcagtctacccctcccccggcggcagcgacgagttcatcccgctcttcctgtgccagaaacgcatgcctcggagcgccatcgacgagctgcagggccggctgacgggtctgcgccacgaaggcgagaaaatcacgctcaaggtggtcccgctggagaatgtctggaaggaaggcgtaagggatggcaagacgttggctgcgtgggcgttgtatcgggggttgaagatggaggagaggatataattgaaaagaaaaaaaaatggcatggcatgggggatgttttgttgattgatagagtgcatgtcaggtcagtcacatccccatttgtgactagataagctaattgtatataaataatactacacataatcagtcagaagaaatagagaagtaacttctcttttcacacactcaaattgaaaaaaaaatataacattattatagtatagaaatgtacctgtagaatgtagtgaatttgatgatagttatgaaacgccccgagagaatttaattatatcgtgaattgtcgtttatttattgaatgggtggagtggagtagagagagaatctagccattctatctatcatttgcaatgatgatatatcagtcaatcggtcagacgagtcagtcaagacaatcatcgccaaacagaacaaagaacagaccccaagtctatatatatttgcgacctcctacactaatatccagtggccatcttctcagtgtcctccgtatgtacaggctgcgtctacaacttcagacccaacttcctcaccaactcaatgccctccgccagggtccccactcgggcgtcgatcgcgtacccctctgcctcgagcttcttcgtctcctcgaacagcgatgccagaggcacggaaaagcactcgataaactcgttgtcctcgagttgcggttgcgggttctggttctccgggagggacatgtcgacgcggacgtggaccatggtgaggttcgtgttgcagaagccggggtctgttgacaacagaaaagattgcattagttgaacgtggtattctgtgatagaaaaaaaaacatcacactatgaggagaaatagggaagcgacagcgaatagggttcctaccgttgtacatgactgtgctcgtcgtttcagccgtccccacgaacccagtctcctccttcagctcgcggacggcacattgctccggcgtttcaccctcgtcgatcaggccggcgggcacttcgatcacgatcttgtcaatcgccggtcggtattgcttttgcaggagaagttccgggcctgtgggcttgttcagaatcgtcacgatccctacgccgtcaatgggggaagtcggcgggcgggtctagagaagcgtcaagcgggcattagtttgttattccgaaggcattcattttgaatttgactgaagcgaaacggtatgggaacagcatgcaggacacgacgctggcatgctcatgggtaaagagaagttgtttcggaaatggaaacgcaggtcgataaatttccaattgggccagctgaaacgaaaacattgagagatggggggaaaaaaaccaagaccagaagcaacaaagaagtacaagacagccaacacaaggaattgaatccctgctcgaggaatatacaggacaggcctagtgtggaggtgcagcaccacaaaaagaaaagaaacaaagagacttcacccaggggcgcataccggccgctctgctgactcccatgttcgctccacgccaagtggatcaatatatgtagtcttcataagccgtatccaaacggcctctgcgggatcctaaggttcaattaagacaaagaattagttggattgtatctcaatgcggaccaagcttagtgttaatggcagggatcgtttaaagaacccgaaatagagactaataatagtgtgctttctggaagactctcattccatatacaacacgtaccaatggttctcgggagacgagcttggaggctttggcggtgcgggtcgactcggtcatgtcggtcgttaccagcagacccaacgatgctagtggtttggaaaagatgatacgggtacggatacgaggctgggataaataagtgaaggaaacggaacttcccacccagattgagtgtcaagaacaaacgatctgaaccggctgttgatggtcagttggcatggtggagagagcctggacaggtgatgtcactggcccaccagggctgggcccttatcttatctcgccattcacccctcatttgacgtccaacccctcggatagagtgtgattgcaacagaacgacccgcaatcagagttctttgacataaaagagagattaatattttattctgcgatacacctcattcctgaaatctgattgaattacggttaccgtttcatgagatacacaacagtaaaattgctaaatgcgcctgcaggcataccaccaaataacccaatttcagatactacacgttgtagggtctaggtataggtaatcaaaatacaataattaatatttataaatatataaatactcttatctctctcacagtatggtgcatcccaccccactttacccagttccatttccccgatattcccccatctgagcggggctaaccggagagagcatgtctcgcatcccactctaccaagtcgagcaagctgcagatttaggtcagcatgcatacctacatatccgtccccagacccatccataccaccaagatatgggggatatcttttctggttagtcgggtccctatcgcctactaacctgggtaggtaatgtatgtacagaacaattgcaagggggatgcgggcacagcgtaccatccatttggctagactaggtacctagtcaattgtttcatggggtaggtacctggccgggaaatgaaccagtcaactaaaataacgcagtgcaagcagcgggattttttttcgacccataacgacagaggatctgcagggcagattaacctccctaagataagcacttaagtactgtacagtacatacttttaagaaccagacctagaacagacctcgacagagagtcaagaaaaacaaaaaactgtaaatattcgctcacgcctacatacatagagtcggtacatacctaacctgggtaactgaacatctgtgacaccatgcccttgcagcctgcggctcgacacgtgagcaagtcagctgccatcagcattcagctccattcgcccaataaaaggtacagtacgtactgtacatacaattgctggattccagaatgcatttgatgatcgtgcatgtgtccagattccagaaagttattttactaagggtactagtacctgtatatgatcgatcagatgtgctgtacttcctattggaatgtatatgaacgcccaatacatactgactgtacctgcagtgttatctactgtagatactggtttggcgatgatcctcccggagtgaatacaaaaacaaatcttcaacacagactcaggaatgatagatagactaattaattccaccaaataataatacctagtaataataacttgtcaccataacttgcttctaatccatccatccatccattagaacctaatctaaggatcaatgaaggtgtgactgacacgttaggtactccaaaaacagcctgccccatggtcgactctcattatactttccgccacgatccatccattcaaacgtaccccggtacgcagcactacctcagccagtcaccagcaggtactccgtccacgcatcaccatccatccattaaactgaattcattcaccgtcttgaccgttcccgctccccgctactacctagggatcgcacataggtctagactgcgccactgtccttcctgtacgctaggagtcatgcgttgtatgcatgaatggacaggatgtagaataattttttatgagtgagtagtgcagatgcctcgaggagtcagtctgtgtctcgtgagtcatttgtatgttctagatagacggtgcatgtcgtacgtcgggactaactcggcgacggtggggtttggcctgctttttagtctcagtccggtgaaaatttttgtggggactatatacaacgtctacaactactacggaatactccatactccatactcaatggcaacaagtattgtttttctcaagcaattctatttcctatgggctatcgctatcgacaaaacaaatgtctattgcctagcacaggaaaagatgcaagacattcaaagtagacgggcaaagcaaagtaaccccgcaaaagaaaacccagacccatttgtgaggataatgcccgtgcgtattcatctgtaaacagtagaaatcatgccgttcattaatccatcgctcatcaaagaaattgaagaagcatgtgccatcgaatctctaggattcgaggaggaaaaatgaaaaaaagcccgaaaaaaaaaagtgtgagaaggtcatcgcgcccgttgccacaaaacgccgtttgcccaaagtgggaaggggaatcgtcgaaaaagtcgaacgagagaataaaaggcgtatctaataagaatcgttctcgatctgctggaggcaagactcgaactcggcccagtccttcatgacaaccttggcacccaaatcggtcaacttcttcgccatctcggctctcttatcatcgccatggtagctgccaacataggcaatgagaggaataccggcacggatcgcggcgagtgcaccactccggctgtcttcaatcgcgacacactcttcaggcttcttgcccagacggtcgagggcccagaggtagacagcgggatcgggcttcgaggttggcttgggcagggagctggccgcgctgaagatgtggtctgggcggaaatacttgtcctggccgaccttcttgatggacgccttgactctgcgcagagcggatgaggagacgacggcgagaccgtatttgccttggcggtggagtttctccaactcttcgttgacaccaatgcagggttgcgccttggcttccagcttggcaatgacctggttctcttcttccttgacgtagcgctcgaactcttccttgggcatgtcaaagttgtacttggcctgaagcgagatcatcatgccgcgaaagttctgtccaacgaagtcctggatgagctgctcgcccgtgtagcgatcagtgatgctccgtttcgccaagatctcattggcaatctccgcgcaggcctcgaaggccaattcctcggacataacgagggtgttgtcgcagtcgaacaggatttgggtgatctgcacaaggatgctgtcagcatagtgggtccttgatgtcactggtagatcagaagctccatcgtaccttaggcatggttgcagatctttcgatgaactcgttgatatgatatcaaatttgtgtactcggagtccactggacgcaacggctggatgggcagcgttgagaatgagagatgtgagagtggcagagagagaaaagagacgggagacaagagaggcggaggagataaggtgaggtgaggtcagtgaattgatagatggaagatgttgcgatggtgaatggaaaatggaaaggagagagaaaaatacgtggactgcaggggagatggtggaacctttaagtacccaatatgggaagagcccagcgagtgacgctcatcacgtcttccacgaagggtagtgatgatgacctcacatacagggcgggggcctgtttcccttcgggcaggagcgggatgggtgcctcagccggctggctagtgacgtcgtcggctgggcgtcccagtcttgtccgggcgtctggcgctatcggggggttccggggcagcgcggcccttgagtcgccttgggtgcaacggtaggcttgagacgcccagctgcggcagtgtcactggcaccctctggccactgcgggtgccctcaaggcccgcgagcgtccctaagagcccctcgacgccgcccgccgggaaggcgtgcgccggtcgctgcttttccgccactaacccgctccacccgcacatcgccatccgcaaacgcgcattggctgctggagagaggattctttcattgactcccggtcaaccatttcggcagtctttcaacgcgcaaattaaaggaactttccagtcagcagagacccgctccgggctgctagcttggctctgcatttgatcgctgcgacttttttctccggatcctgcctagagcaggaaagataccagtcctgattgggtggagatttcaggaacaataatttctcttcatcttcttgtcgtctgagaacaggcttctctctctttctacgcgacacaggaactagggattcttggtccggcaaaagcggcgaaaatgagctccggcgatgcgaatttcccgatatctgtttcgtccctccagttcccctccgcggcgcaatctgtctcgcaaacgctgtcgtcgctgcggcgatctacgctctcaattacgaatcgactgcgatccatcgaagcggattctcgtttcgtgcaggaagtcgcaaaccactaccgtcttcctctcattgccaacgagagatgtgggagttggtatatccccccggagagaaaggcggggagtgcctacttcaagagcactgatggccacactggccagtgggatttcagttttcggagactaaatctccaggttcttcctattgctcgagagcatggcgggtaggatgcccggggcccctcaatgctcggtctatgactaaaaagtgtctgcttagatgcatcatcgtggactccacgcgcaggggtaaacgtaagtttttttttctcactgcgcccctgcgcagttttacgttttgcatgtgaggaacaccagagtaaccataggacaacatgtgcagtgatgcccgatgctttgtcgaagacggtccctatctggtgcgccgtaatgaacagggcgctatttccatcagataccgggctccatgcggtgcaattcccgcctaattacctgggtgaatcagaagaataccagatcgaaaagagaatagatggatttgtaacgtccctgaaagtaagctaccaggacggcgaccaaggcgtcgcatggaaccccgactgatcaacatccgtacaactaggaactgaaattagacctggacgaacttcgaaggagccttggtaagccaattcgaatcgcatgggcaaaccaatcatatttctacccgacagatctccaaaaaggggatgactataatcttttcgtcctctgttctgcttcaaaacgagtacatggggctgaaatgtccgagggcggttatatccaaggtgcaggtgatgatagtgagggatggtctcatggcctgacgcctcctgttttctgggcaaataaatccacgctctttgctacagaagaaagtgacttgcccgagcttattgagcagctggtggaagaacatcgcaagcacggagctggtccacaagctacactgatccaaccaactcggaatctctatattggccaagcaggtgatgcttcaagcagaagtgaggcgtatgacctcgtcatagcctgccatgacaagcctgttgagtctgaaggcgatgcaaagaagctcaacctaggctgcaacacgtctaagcttggcagtcgagacctgcggaaagccttagaccgagtgaaagcatttgtcgagactcatctatctgcagatccatctcgcacactgctggtaacttgcgaaacggggaaagatctctccgtagggacactactggccatcatctgtctgttctacgacgataacggtaaccactgtttgaataaatatcgaatgttccttgttcagctgacggttctgcgcaggcaactttgtcggactacaaacaggaacttcaatggacaagcagttcattcggcagcgactggcatggattgtcacgtccaagcatgacgcaaatccttcacgggcgactctccagtcggtcaatgcattcctcatgcaaaggccagattagaagtgcccttaggaccaaaggctacccatgaattgacagatgttgaaggtttatggccggcgccttggtggtccctggatccaggatatgtatctttcctgcgcgcaggattttattcgttgacaactgcttcaacgatggctccagcgcttccctggtctaatccgtccaacacggccatatcatcctggctaatctcaaaatcataaacatccgcgttcgcagcaatccgagaagggttttcggtctttggcagaggaacccattgcttttgcaacccgtagcgaacaaggatctgcgccgtggtctttccgtacttccgtgccacagaaactaatgtagggtcgttggccttgtaattacggacgagtggacagtacgcttctacaacgatgccatgcctcttgcagtattgatcaatgacgcgctgttgacaccacggatggagctatatatcgcgccagttagaactccacgctgtaggcggattcaatctaatagaacctgggacagcatgctcacctcgatctgattgacgtgcggtggccagaccttggcgtaggccttcatctcctccaaatgcttcaccccgtagttgctgacaccgatgcttcttgttttgccctcctcataaagtctctcgagagcctgccacatctctttccgacccgctgcgccagaactggtgctgtgaatgaggaagagatccacatagccatccttcccggcgatcttttcaacgctattcaagagtttctcataggtcgcctgcggtgagcctccaggcgtcatgatttttgtcgtaataaacacttcctcccgtgggatgcctgattgtcgcaccgcctctcccacttccttctcgtttccataaaactgcgcggtgtcgatgtgacggtagccgaccttcagggcgtccagacacgcttgcacacatttttgatcgtgagcgcggtagacaccaaatcctagacgaggaatctggacgttggaatttgggagaggtaggacatcggttatcgcgaattgcgtagacatgatggctccggcacggtgtgagtgatcgatgatgcgctttggattgatacccgatcgttccttggcgatatgacggtcaattcggtccgcagaaaaagatcctgaagttagttatatacagagctgctattgcatatatccaatggcggtcaaattgttgatgtgtggcacgagatgttcgcaacttgactccctcgatgatggtttggtacccccacttggaggggttcccggaaaattgatatctccagtcggcccgctatcggaaggggtaactcgaagacgcgaagcatcggcattgatccgatccagcctacagagtacggagtatgccattctaaacgtcatttctgtttctgttcgacaaaattatgtctcaatcagactttgacttggaagtcacagcagatactgggaagcgttcatcgcaacagccctgcaagccttgaaggtatcacgtgaactccggcttgctgacaagattcaactcgcggccattccagcatcttggtcattcccaccaatgaactgtatccttcaagcttgtcctgagtaatccgtgatattattgcctatcgaatttctcgtccatgacaagattgctggcaggaaccattgttcctacctgtttgacagccgtctttgtggccggagggaacagcgtctaatgtcctacgctacatcaaataaaggttcacgagccaacctgcaactctgggtgactgcctaccaaacagattggctgtcttcattgtcggactgtgtcctggagaacccgatccagagcctctttcccaatccggcgaagatcaaccctccacttgttcgtttcgatcgctaaaaatccccgaccacgctttctccgtactgacgtgcccccaggggaacagactgcggagaacatcactgtcatacatgtggttatgcaaggtgtatctgcagagacctcgcggaattagctcggcacaaattttccgctcaatgtggccttgtagcttgggatggatagccttgcaaactgtctctgtactggcgtccaggtgaagaccaatgaattaggtaggattgataggagtactccgtagtaatcaattcgtggaggattgatcgtgcgtggttggtccaaggcaaggtggctggctccgctgatcaatgtttagtagcattgcaacgtggtgtggaagactgttgaaggacatatcctctgccatgcaggtctaaggggacaatatttcattcagcaaaacacaccgcctgggcagttgatacttgatagagtcaatggggatagaggacaaaaatctagaccacgacgccatgcttgaaaatgatagggcgactgtttggaacagcaaagaaagtttgtggttgagcgactctcggtccctggttcggttgctgtggaggctgctattgttgacaacttctaggtagttgatccgagccagctccctaagccacgccgggaaaggaggccctcatggggtcccgcagtatcctgagcctctaaccagcagagagacaagcttttttccagcattaatattgtaactcgaacctggcttctaaataaataacaatcctcggccgatctgcagtcgagcttagtccgctgtgccgaactgcagcatcgatcagtgctgcgtgcgacccctctctaaatctcaccttcctttaccccatatcgtcctccaattgttgatttaccatccggcacacccaccccttttttgtatctctggaaagcccttgatgagtgtccgccaccatcatgttgccggtcgagaagcagtggattaatgtacagcaaaagaccttcacaaaatggttagtcgtctcaggattgaacctcgtctggctgtggtgacctcggagctcaacgaatcttgacaacaggatcaacaacaaacttaaggtccgaaacataaccgtcgaagacctggtgcacgatctttcggatggcgtgagtcacatctcctctgcccgtacgccttctctgtcaacagcatccctctgacctccattaaggtcatcctcattcacctgcttgagatcctgggcggcgagtctctcggtcgatatgcctccaagccgaagctacgtgtgcagaaattcgagaatgtcaacaaaagtcttgatttcatcaaggggcgggggatacaaatgaccaacatcggggcggaagacgttgttgacggtaacagaaagatcatcctggggttgatctggacccttatcttaagatttaccatcagcgacatcaaccaagagggtctctcggcaaaggagggcttactgctatggtgccagcggaagactgcctgctatcccgaagtcgagatcaaagatttctccactagctggaacgacggactggccttctgcgcccttctcgacattcatcgaccggacctgatcgattttgactccctggacaagaacgatcaccgtgggaacatgaagttggcgtttgatattgctacgaatgagattggcatcccggacctgctcgacgtcgaggacgtctgtgatgtggccaagccagacgagcgatcgctcatgacctacatcgcttactggttccatgccttctcgcagctcgagaaggtcgaaaatgccggtagacgggtagagaaattcatcaccaatatgcaaggcgcctgggagatgcagagttcctacgagcggagaatgagggagctgctccgccagatcgccgaacagagggctcaatggcgtgagtcatccttcgaaggaacctacgcggacgcgaaagaacagctcaaccagctctcgcaatacaagagagataagaagcggaaatgggtggcggagaagtccgatctcgccgctctgctaggaaacatcaagaccaagctcagcacctaccgccttcgcgcgtacgagcctcctccagagctgcggcccgaggtccttgatcgcgaatgggaaggccttaccaaagacgagcaggaacgcagtcagcttatcaacgagactattcgagatatcaagaatgccctccgtcgctcatttgcagacaaagccaacgatttcgcgctcacgctgaagacactgtctatggccatttccgggctggaaggcgacgtggaggatcaactcgctcacgttcaacgcctgaacgacaatctaccccctcttgatgctttcttggaaacaatcgccgagctggacaaacagtgtgccgaagcgaatatcgaagagaatgactatacaacgtacaccttggatgacctatcatatgagcttgggctggtaaaagcgagtgtggccaagaagctggcattcctcgaaaaccaaatggtcgcacggaacatgacaaacctgacacctatccaattggaggagtttgagtcggtgttccggcactttgaccgcgacggctcaaacactcttcatgagattgaattctccgcagctcttgcgagcttgggactcgtctacgatgaggacgagatgcacgaagtcttcctgcagacgtctggcggaaagtcaagcgtcacgtttgagcagttcatccgatttatggtcagcgtaacagaagaccaaaacacggcggagcaagtgtttcaaagcttccgtgaggttgccgacggaaaggtgtgtgccagatcatttgtttttgagttctcgactgcagattccatacgcatactaacgctttcatttcatagccctatgttacggaactggatctcaggcattccctcattcctgacgaccttatcgaaaatctcattcagacgatgcctagacatgagggcccagatctcctggaggatagggacgttcccaaatatgattacatcaccttcatggagcggatgatggatactggcaacaacaatgggcaggaccagtccagtggccaccagaagcaaccctcgatcaacggaggccattaaaggatatccgattttagcatttacggtcgtttgcggggtgttcttctttccttcggtgggccggtgttttggggacctagcggcggtctgttatttgtcttttcccataaattcttaatcttgcgtacaggacagtccttttctttcttcggtgcgctttctggatacagcccatagcctctcgtttggtgatgccaggtacgtcactcatcatcctctcaaattgactttactattgttgcatacgttaatacttcgaactcttttatctttcagaggacagtaaaaccgagaactggtatctgtatgcttaccacgtagcttagttgcataagactggacaaaaatatcggcttgcatcaatatattatttcttcaattcacatttgacaatcattgcgtccccactctaagcttcgaattgtatggatgtattccgtacatacggagtacgcatagcttgggactccccatacggagtagatcatcgcatcacgtgacatagcttctcagccacctgtaaatgatcgacgccccagtgtcatccaaactgttctcacaggagctcggaactctcacttttcttccacctttcttctgttctatttgcccattttctttttttcgactgaccagtatacccattgatagagcaattgttgcagaaatggatcgcagcctggatgagatcatcgctgaacgtcccgtaagttctccgagctgttctgctgcttgctgcttgctgctgcagaacgtgatcgactacgtcacatgctagagactgacatgagcgttcacatatagaagcagaaccgccgtggacgtggaaatcgtagtaatgccccccgcgacggcgtcaaaaaggtgcagtttggccccttcgtcctgccacgtcctgcctgatcgacccgattatctgacttggttccccgttgctaggtctccttcctcctcctcctatcgcgtcctgtcgctccgtgaaaagcatccgatggtcgggtttcatggccctcgggcctaaaccgcggccacaatgcgcgcagaaagatggatcgttatcacaataacatagaatgactccagctgaccttgtcctctttttcttcaaatgtaacagtcataccgagaacgtgttgatctagatcggtaagagtttgctctttgtttcggaggtttgggaagggttgctaactgggtttttgacagtgattgggttcatgacaagttcgaagacgactcagacagtacgttctagcctcagaactcgagcaatgtcttgttctctggcttacctcttttgttctcttttcagcgcctacatatcgtcgcgagtcccgccctcgacgtggtgatcgctactctcccgagcgcgagcggtatgtttttccacatgtcgatcgttatgtacaagttgctaatgtgagtaatgtagcggccctacaggggctaggctccgtattgaaaatcttcactacgacctgacagaagacgatctggaggtatgtcaaacacattcttatcatagagcagccgctgacgaggctttttattggaacaggatctattcacccgaattggaccggttactcgcgtgtctatcgtatatgatcgcgccggacgctccgaaggtatcgcgtacgttacatacaagtacattgaggatgcgagaacggctattcgtgaattcgacggtgccaacgcaaaaggccaaccgatccgcattactctcgtttcttccggacgcggtggccggaatccgtttgacaatatcgagaagccgaagggaagtctgtttgatcgcatcgaacgcccacgcgatagacgcagcctcagtccggaaagcgatagtgatcgtggacgtcggcgtggaaaatacggtcctcgccgtagtgatgtctccaagccccctcccgaccacattgatcgctatgtgccgggacagcgctctcctgtccgccgcggacgacgcggtgaacgacgtgaagcgaagagaagaacggacagcaagggtcgcccgctggtcaacggtcggccgagaaagactcaggaagaacttgaccaagagatggatgactactgggaaaatgccaacgtcggagcgagcaataacactgaaaaggaagccgctgccccagagcagactcaagaggcggcacctccatcgaacgctgcagctggcgatgtcgatatcgacatggtcgagtaaaccgacaggtgtcctgggatacagtcgctcttgaatccttttttatttgttcttcgttcccctctacaaaaacaaaagttgcgctggtatcgggttatggttgatattttgtgttttttcagaaccaatgcattattagtattagcgttcaactgaatgtctccttcggttcggcttcggtcagatagtccagcaagaagaataccaatttgatttttttttctccttctctctacgtttttctttgtccggtctgtctgtagtattgtagtagggccctaaaccggtcatagtgagtaagctaccgtacttacgatcaataaatcataaattgatttaaattgagatcgatggaaattctattgttgatatacgtttgtttgtgaaacaagttttaatcgattgatttgatgaatgaacgattcatcatcgtcgtcgtcatcattgtcatctaggtaggtagcctataataaaaatctatacctatctgttctgttctgtcccgtcttgtctaccgccagagtccgtatggctcccgacaggctttccacagcttgatggttccgtcttcgcttccggtgccgtacagcttgccgtctggtgagaagctgacggaccagatcgggccgtggtgacctttttggacttctgtaggaaggaaaaagaaaggaagtaattgtgttagcgttgtgcttctatgcctttttttttaggagagagagcgagagagatgggggaggagggaagacataccaagttcctcatcggtgtgcaaatcgtagactcgagcccaggtgtcctctcccgcaccaccggtgacgaaacgaccagtctcgttgttcacggccacactggcgacctcgtacttgaagtcgaccttcttgagcaatcggcccggcgttgcgccatcgaacagatacacactcttcccggcggcgacgctcaggatgcccgggtcgttcggcatggtggccaggctgttgagttcgcagctgccaatggtgccctcgaccgagtactcgacaaccggatgtcgtgaccgcaggtcccaccatcgaatctttcggtcctctgctgccgtggtgaggatgttgtagtcttggttccagacaatggacttgatcgttcccccgtggacgccgggcccgatttcgtagctcgtcgtggactcggatcccgaactaggtccgttcgtcgagcccgaggatgacccgttggagtcgctccgggtgaggtcaaagatgcggagcttcttttcgacgcctccggtggcaagaacctgagggttcagttggataggaaatgcgaccgcccggacaatgtgcgagtgctgcagcgtgtgaaggcactcgcctgtgtgcgtgtcccagaccttactgccagagtagttagcaggatgaacgctgtctcatagatcatgttggtcctggacgtacgcggaaaaatcggcagcggcggtagctgctatgtttgcatctgccgatagacgagcctgccatactgcgcctttgtgtcccataaacgttccaatcctggacagcaggttagctcgcttgcaaaccagtttttgtgagtgaagctggaacgaaccagtcgccggtaataccatcacggagcataggattgttatctgcagcattggtcaggttttgctggagcaatttcgagaaagatgggtgatgatacctttgcatgccgagatcaagtaatactgatcatcttccactatggaagaaaagctgatatggggaacagggcgcgaatgtccatgacaggtcaaaggaacgactttggggatgtctgtcaactgtcagcgataattccctttgatatcgacagcacactcacccgaagccatttgggctcccagaaagacacgatcgccaacccacccaacagatgaataccaaaaattgctttagacactgattcccagagtgatgaaatatgatatgtcaagcacctggcatggaaaaatcacgcggaaatctcctcaaagaaaaatcaaatggagacgacggatctgagattctgatgacaacagcaatgcaataataattcaaagccctgaatcatgaaaaaagcaccaagtaaggcatcatattcgtcaagtcgtaacagccaagaaaatcgaaagacacgattggttcgctggcgagggacagccagggacggacggaaggattgaggtagaaggcaaaaaaggaaaaaagaagcaaccaacgccagtgtcctaggtacagtacaagtctttatcactggcttagacactctgcgcacgctcagagaatccagcgttgtttgcgcgaaggttgtggtctctctctggaccccggcagtcgagagggcaggcgggtattcgaccgtagttaattagtgccagattgagatggagaaaatgtccgatatgaagcgcgcctccggagcaactaacccttagcccttgcaaagccccagtagggaatagcgcagtcgacaaccacgtgaggggttcacggcgacttgtcaaccgccagcaggaaacagcgcagcaggtttgataattcctcgccggttgcggcgtctatgtatgaatcaacatgccgttttgtatgcgcatctcgtctcgaggggtgaggtgtgtcgattggcctggaaacactcgacaacgatgattctactgcaggaatcgattcagcactctcaccgctctttgcaggctttccatcttgttgattttgctgctctcgacgctgctacatgtggagatgatttccaagaactatcaaaggcatacataatctacctcatagtccactcagtccagatgcaaagccccactgcgcatagtcagtgggaatcagagcatgcctgtacaggccatagcacatccatcagtgtattctcatgcttctgagacgtctaatatacaacatactctttcatactacatgcgctggatatctagaataatgctacagtaacaatgcgcatggctgaatctactggctggaatctgttcctcaccgcccacgtgatgcgattaagccaccccgcagatgacggcacatgacggcacaatggcgggcggtgattcccgactgtcaacagatgcagtcttctctcttggcagctgcttgtgtctcctacacttgaccgaatgtcttgctgagacagctttggtttcggtcgcttgtaatctgcgttgccttgacagtcgctggccagcacataaactttatgcatgtctgaatacaagctctccgcgtcattggagggccacggcgatgatgtaagtggtcgacactcttctcattcctattgccataaacatttggctgttgtgcatgctaaatcgaagcactaggtacgcgtcgtggccttcccaaattcagagacagtgctcacagcctcgcgcgatgccacagttcgcatttggaggcgagtgtcttcgcagccgcccgcctacgactacaccatctcttcacacggctccgcgttcgtcaactccttagcctactatccgcccattccgcagttccctgagggtctgatattttcgggagggcaagataccataatcgaagccagacagccggggaaagccgcgggggagaatgcagatgctatgctcctcggccatggccacaatgtctgctcgctcgatgtctctcccgaaggcgggtgggtcgtaagtggaagctgggatggttcagcaagactatggcgattggggaaatgggagacagatgttgtgttcgatggtcaccaaggtagcgtttgggctgtattggcctacaacaaggaaacagtcattacgggtaggtgacgtgttttcctccgagcttgtgctgtaaccgcagggctaattcatattgcaggctgtgcggaccgtatcattcgtgtcttcaacacgtctggaagactgctgcgaaccatcaaggactcccgtgacgtcgtcagagcgttgtgcaagctgcctgataaccacccctccggagctcaattcgcctcagcaagtaacgacggcgtcatcagactatttacattgaatggtgaccttgttgcagaacttcatggacatgagagcttcatctactccctggctgcccttccgtcgggcgagattgtcagctccggagaggatcgaactgtgagaatatggaaaggcaccgaatgtatccagaccattacccatccagcgatatctatatggtgcgtggcagtgtgcaatgagacgggagacattgtcaccggtgcaagcgaccgtatcgcgagggtcttcagccgagataagaaccgccaggcagagcccgctgtgattcagcggttcgaaactgccgtgagggaatcggcaataccacagcagcaggtcggaaatatcaacaaggagaagctccccggtcccgaattcctcaagcagaaggctgggaccaaggaaggtcaggtccaaatgatacgtgaggcagatggcagtatcaccgcccacacctggtcaacagcagcacgacagtgggtagccgtgggcaccgttgtcgactctgctgggagctccggcaggaagacggagtatctgggtcaggattacgactacgttttcgatgtggatattgaagacgggaaacctcccttgaaactcccttacaacctaaatcagaatccctacgaagccgccacgaaattccttcaagacaatgagcttcctatggggtatctcgaccaagttgcgaagttcatcattcagaacacgcaaggtgcaactatcggccaatcaagcgagtcacagcagcctgcgggtgctgcagatccatggggtcaggaacgacgatatcgcccaggagaggtcacgacggcccctcagcctccatcggcggctccatggcgtcaagatgtgcttccgcaacgatcctatctctctattagatctgccaatatcaaagtcattgccaagaaggtggaggagctgaaccaacaaatcgtgagctcaggtgccaaggacgtttccctgaacccgccagaattggagactgtcatggccctctgtcgcctactagagtccaatgaatccctccctaaggacaacgcgattcttgagactggaatactactagtgttcaagatagcggctaaatggccaactgccaatcgactacctggtctcgatcttcttcggctactagcagcggcgactccattaactgcccagacgaaatatgatgatcaagacttgatctccgcgatccagcagagcggggtgttcaacagtcctgtgaatgtcaattatgcgatgcttacaaccaggatgtttgccaatctctttgaaacccctgccggtcgtgagctcgcagtcagcaaattcgaccagatcctggatatggtcaagtcggtcaccacgtatgaggaaagtgcgccgaatcgtaacctcaccattgccgtgaccaccctgtacatcaattatgcggtgtatttcacgtcagaggggcgagccaaggctcccgagtcgtcggaacgtggacttagcctgcttgacgaactagccaagattctctcgaaggagaaagattccgaggccgtctaccgcggtcttgtggccttgggcacgctcgtcaaggagcttggcgacgaagtcaagagtgccgccaaagacgtttacgactttaacaatgtgctaagcaaactgttggacgccggtcttgaaagggagcccagaatcaaaggcgtcgtcggggagatcagaggcttgttatgattggagatttgatagatatgatgattgaacgtcacaccgagtgtctcggaagctggttccccagcattgcatcaatgcatgaaaaaggacgaggttagaactgctcgacttatttacaatagcgcatagcaattagatgcattctagaccatatgaacttttctgtcttgcattccacaatcacatgttagcagatattggcgaaagtgtttttgccagaggtatttaacatgtctccctggtagatttgattcgtaaagcgtcgcgtataatgaattcgtggtaatactcatatactggtcgctgcccatggatagtaggtttctttcaagggctagttcatggatgcatcctcatgtcgccaacaaaaccaaaaaaagacatatatatccttttaaagcttctcatcggcatccacaccaacctcgacaatctgatcgattccagggtactctggcaaatcgagatcgtatttctcagcgatgtccttggtcaggaaccggccgccgacaaagtgtctgccacggtaccatttcacgcacggcttgggggccgtcaggctgacgagcgcgccgggcataaacttggacccggggccttccttgggcgggccggtggtgatgtcccacgagctgggggcgtcgatgctcagcacgggcaccttggtctcctccatctggtagatgatggatgggaagggctcgcgcaggggacccccgaaggagaagccgaagatggcgtcgatgacgaggtcggcggatttcagggcctcggtgaagtcggggacgaagggtacgtttaggttcttcagctggattttgaggcgctgtcaagcgggtcagacatctaaacataaatatggaggcttcgtaaggcatatatagatcactcacctcgtataattcattcttaccctgcttggggtagtaaaccgaagggttgtacccgtaatgggcgagatgacgagctgcgaccaggccatctcctcctgataggcgtacgaactatcagcctcactctgtatggaggagtctttttaccaggctcatgttcataccattatttcctgggccgcacacgacaaggacatttttccccttgctgagagggtggaaacggtacactgttccatgaattggtcatatcagtttcttgcttttcaatgcgtagacaaataatgtggtcttgcgcatacctgcttgtgaaacagaaagacccgccagctccatcaactgatcgagtgaaaaaccacccacttccatgaggtccttgtcgagagccgcagcatctttgggggaaattgcctatttattcaataatcgggagtcagttggtgggctacaaataaaaagaagaaaagcgtagagtgaattgatgaccaaatccatccataccttgagagacatctttgcaaccgtgctgtagcgccggtacccagcgagtatagaactgttgtatttcttgaacagcgtcgagcgaaacatacagcgccttacacagcgcggcgctgttcacagtatcagtgggaaacgttcccccaaattgggtccgatttatctgtttggaggggttcggaagtcaattggaaggcagttagatgcgagttgatagttgactgattccgtcaaagaacaggtatattacaaggtagctttatctcatcaatcatgaattagttacgttgctacaaacgtgttctctccttctttcgctgagaaagaaatatcggtggacaaagtggttgttgattatcattgcatcatagttaaggctattgcccgccttcatctccgacaaccagcgattcgacaccccgtccggatcaactcttgtccgaatcgccgggcctctcccgagcggaattgctccagaataatagaaaccgataactggagaaaaaccgtcagggacctgtccacgcgagaattggggattgtatctgtcagtcaatatggtggtcaggattcgtctctcgcggttcggaagacggcatcagccgttttacaacattgtcgtcgcccaggcacggtacgtgagaaattgctttcaattccggcaggcccaaaaaaagtcaagttctacggcaattcttgctgcctgtgctactcctgcagtcctaagataatagaagatatctcctccgatgatttcgtgttatcgtacttgctaactcgattttttttttcatctacagatcagcccgcgactccaaacccctcgaagtcatcggcacctacaaccccatcccccagaaaccgacgaacctgaccgatgaagaagcgcaaaccgcgaagccgtacaaggagattacgctcgaccggtcgcgcgccaagtactggcttggtgtgggcgcgcagcccagtgacacagtgtggcggttactgagcatggtacggcggtcgctttactattgcagtcgtgattctattctgttcttttttttcccggagcttgtgatacaaattcgagaatcatgatgggtagttaaaccggatgtgtatgctaattggcgtgtcttgtgacatgacaggttggcctcgttgagcccaagcggaagaactagacgacgacctctttgatcccctggcgcctggtcttttaaaaaaaaaagcagatgaggatgaacatgcagatggcaaaattgcatctctgaatactccagcgcgagatctcctcgattcgatctgatttctcgtctcattccgcattctacgagcaagcatatatctacgtctgagatacggcgtctcgtcttagaaaagaaaagaaaccgggggatccactgaagagaaacgtccaattcagcggtatactgacggagcaggaaaaacaaagtcaccccggtactgctctccttacgagtgtgggcatgtggacggtgtggagggtgatcattattgtgggaaacaaaaatatttcagcatttccatggcgttttgtgtttttgtgttggaaacgagactttgaattgaatctcgtctcgtccggctgggttgactgtattatttatcgagtttgaagggatatttctcaatcttgtatgtatgtacagtagagtatcttgacttgggaaatttttgaaattactcaactgctgtccatataaaacaagcaccttcctacttatccgtcctagtttgaaaaaaaaaagagacatcacagtgcaattgttgattaacgcctgtgactatctaccggcacatcttctggtctatataatacagaacaaccataagcaaggtgatgaagacgaataaccttgcaatttccaaatactccgtaaatagtggcatgccacagtgggtccaagagcaacaacttcttgagcgcgggccatccatctaagtgtggagactgactgggccatttatcagatatggagtacggagtactccgtacatacataccacacttgacggataatctatttgtaatatcactgtgtttgtatttgtggtctcgctgaagaaatttaaaaaaaaaaggcttttacgtgcactctcagactatatatatatatgaagataaatgagatgtgtgtagagttggaagaatatcagaactggaagaactaaaaaataaagattagcaataatacgaacacctctcttctcttggctatatcttttacctctgccaaacgaccaataataaaaaaaatatcctagtaatcatcctgcatctcttcgacacaaccaaacaagctctcggcagttctccgtacggagtaaaaatggcaggctaaagcctacctaagcggcagtaatagtacgcagtaggtaagtacctacctaagtggctgtggatatggttggccactaccccaggagctggaccagctgataggaggatacctaggagtatgacttaacagtggcttgttatacgaggatagcaaagcaaattatacatgacgccacccctccatgactcatgtcagtcttgtcaggcaggctgtcagtccaatgggattgctccatggacagtaatacatgaatactagaagcaagggggtcttttacgtactgtacagtacatacagtgcataatccaatgcaatgttcattggatgacggtccagtcttcaggtatggagtaggtaataacttctgatagaaggattctgcctttaaactgccttgatatttgccgctggtaagacagaatgctagttaaacatgttagtgactaggttagattgatcatattatcttagcatctgctacttacttttgtcctgataggtcttcagattcacactatcttcctcttgaaccttgcctactgcctctttaaaccagtcacttatgacattaactgtctctccatgcacagggccttgtcgtgcctcaataatgatgctttcaaggtgggcatcatattcaatgccgcccaggtcgttcttgttgctccaagttgtaaattactcaaatttaaccttaaaagttttatttagtcttcccttgacctgagattatttgtcacataccttgaatttgtcaattaccatccttccaacaattgcgtttcgcagtgcctccacggtatcactcttcaggttctgaatcgattcaacccctttaaggatgtgatcgatggcatcctgctgagaatccatgttgtacatctgcaaaagttctttgctcttgggccttgcttgtttgcactgctcatgatcaaggagagcggccctgtcagactttatcagttcgtctgagggttcagatatgggattggtctttgtgccaaagggaggggcctgagaaattggtttcctgatggacctgaaagtgctttggcatttgacaggggtaggtggcagagcccctggctcatgactcgaccactggccattctcacgaggacgtaatgcagaaggtaaaaagaagagagtttttgcgtcaccaatgacagacgtcattgtctctttggtatcactatgaaggatctagaaccttggtaaagatgccaatatgacaaatatacgcccggggaattgttctgcaactgatggaaaagagggatctataccattggcattcccttgcaaatcctatggcaagtactagatgggcgaggttatatatcttgtaatcatgctgctcttgtctcactttccttttatttatcttactggtctgtatatactgatagaaagcttccaagcctgaggagagctgcacatgagatagagagcctgcttgaaggtactttctttgccttcaaagagtaaaaaacacatgtaactttagtatgtctctagaattacaaagtaaagaagacgtattatggaacaacatcagactggtcacaagtactgtccatatatccacattgaacaaagaaacagtcctctttatttgaaagcccagcaacctataggtaggattctcaacatccctcccaaaaagaaagcaacctggtctggtcctgtggctgaatcaagacattaggtgtgtaatcaacccaggtgccgtctctcctccagcatctgacagagcctacaaacagtatacttacaatgattgcaacagaaggatgggggatagacaaaagaagatagtcttgagcaagtaactataatatccagatacagcgtctcatcgacatcttccttgatcacatgcgtcacatctcttctagtctgctgagtcgcgtggtagtagcgacggtcaactattgtactgaacgaccttctcagatagtaaggtttttttttctttcccagcttagatctagttaatagatagctactaaataaagactcagccccattcgatagagcttccaaggggataattgtcctatcaacaatgaatcagaaatgctcaacattattctctggtaggaatgaaaactttgaaagactacatacagcatcaacatctagaacacctgtggatattctctgcactcttttaggaaagtggaccccctttgggacgaaattccacatgtaatcatcttgtatcgtcatcttccgaaatgaaggcataactttgcccgagttgtcagttgtttcatatcctctctctaaaaccgaacttctgcaataaatataactattattgctgtcaccctctgcaaagttgccgtaagctaatatgataagactttggaggccctttgggccaaaggcccattcagcgaaggctaagatctcctcttctgtagccattggaactattggataggcaaacattgcgaacttttccggaactgccaacagtaagtttctaataactttattgagatagtggaactgacactgacgctcactggcaatcacctcgggtgccagaaagtcaattggattatgtcctgcacgtatgtgcagtaatttcaacgacgtattagtcaccagatgctggagtctcaatctctgtattaactgtcgtcagctgcacagtgactggcaaattttcgtatatgaatgacatcagacgggaaagtcttactaaaacttcaggccgctcacacagtccaagatattcgagatgacacttgcttagtagttggcgtaattcggcccttgcaaaggaagcgacatcctgatcatggtttatattcaaagatccaagatccagttcatggcggtaatcagcgtcaccctcgtacgagtcgaaataattgttatcaaggtatagggtctgtctttcatgatataccaatcggcgtagggaggattggtgatggagaatgccactggcaatactatcagaaaagatctcaacgtcaacagcaaggtaaaacagctcttggaggccttgaaaggagttgagaaacttgacaattccttgcaccgcaccgggttccaaaaggtctggaaatgtcaattcaagggtccgtaactggattttctgccctgaatctgccaaaatttccaaaaataaggaagtatcttcacagtcttgcagccttagagtgtggaggttgctgaagatgcgtgtttgcgaaggtttcaatgtggttggtagtggggcacgcctgacaatttgcagttgaatctttgcgagcagtagtcccattaacacgtgtcataaaggtccttggaggcacgtcaaaagctttggcagctgcagtttttgatggaaaaagacctttcttataggcttcaagtgctaattgcatacgcccttcttttgatatatcagccatgacgcggtgcgttggtaaatcgcgataaatccgatgatagggggggccgaggtggtggccgcgcagctcggtggtccgcgcagctcggtggtggattacgttagccctgattatacgtctaagcattgccgtagggttgacagtgcctcacctggaggctttatattagcactctataggctttatataggtttatattacaggaatacagagggtcgaatgtctggagcctttataaggctctttattatatggtcttactatagtaaaaataggtacctattcacctataataataccctgcgacgagttgcaggcctgtttagtcaacatcaaccggagtggaagactgaagtaatttcaagaacttcgtcagtaatatctggatccaggtcgtgtgatcgaggcacacagaccgcatttctttttatgttttcaatttttcgatttatattgaaacgctgtttttttttttcgagtaccaccagtacgctcttcccaagatgaagtcatcacttaaaatcaaccgcgacgccacaaccaactcagataacagagaatagcctgcaatgtccagtagttgatcacctggttggtattttagtattatggattgcgagcagaaatcatgtggctcgagatgtaaggctgtggaccaaagcacaagccgcttctttcccttgtatcagttctcacaagactcgtagaatataaatatatatattcccagatgctatgttaatctctgcgtccgagtatcttgcgcaaagcattttcttaagctcgagaataccaaaaccattcattatatgtacagtacccatcagaagaaaagggagaagagagaaaaaaagaaacgtcgtgacgaattcctttctttctccgccacttcttccagcgcagaatacagatcaggaagaaaagcaagtcactgtaatatagcagaacatcagataagaaaaaaaaaggaaagcaaggcaatttttaggaacagccgaacgcgggggtcgaacccgcagccttgcggtgggtctcatttaagagccgcacgctctaccgattgagctagcccggcagctgctttgttgatggaagaagatcaattgtgatagaagagtcgagtcgtggtggagagattcatcaaaaaaatttttttttgcctccgagtccggtccgggatggatcgccatgacataagcagatgcttggcatggtggcgtgccaagaaaatagatggatctgctattggaacgatctgtatctagattagataacgtccaagtccctaaggttaccaataatagcaccggaggagtaaagaggggctacctacccaggtacgcagtatctggcctcaacaacagaaacgcttaatctgaaactaagatgggaatatgtgaatattccgcaagtaactcaccagaagagagataggcaaaaagaaaaacaaaatataagcgtatatgaacaacgatagaacaacaagagaaatgacagaagtaagaacagcttacttcatcatactaaacccgttgtatagtataacgataaaggcaagacagaaaacattattctcaagataagcagttaaggtaaaagatgaagacgaagatgatgaagatgatgatcaaaaggataaatgaagatatacttgtgctgacggtggtgataggatatctaacacgtcgtcaggcgcggggttccttaaactctccagatcttagtcagcttggtacctaagccagactggcacccccactacgacgaacacaacgcgactgtagcataagatacgaagggtagaccgccctggtcaaaacagtggaattctttttacaagtattaccgtagttagacttcatactctccactcaggactctcccagggcatacagaggaataatggcaactccacgctgctttatcatccgccatggagagaccgaatggtctctcaacggccggcacacgggcattacggatatccccctgactgccaatggagaaaagcgggtaaaggcgactgggaaagcgctcgtcggggacgatcggttgatcgcacccaaaagaatagctcatgtgtatgtatcatgcccgttgcactgatgtgtgtttcctattatgccattgtatgccattggttgaccaggacgcaatggatagttatgtctccccgcggaagcgcgcacaaaaaaaaaccctggagctccttggcctcgggtgcaaagaaagacttccgtggcaagaaacgcggaagccggagagcgaagaacccatccgaacagaagccacagttgaagtcacagaggcagtccgcgaatgggattatggcgattatgaaggcttaacaagccagcagatcagagaactcagaaagcagaagggagaggtcccatgggatatttggaaggatggttgtccgggcggagagtgagtttaccctgtacacgttcttgtgcttttatgacatatgcgacatttaaaattagacgatgttcccatttgcaaagaaactggcactctatcctcacaatttgcaatttgaactagatcaccagaagatgtctgtcgcaggctggacgccctcatcgccgaaatcagagcgaaataccacagcaagtgcttcggagagtcggccgataagaacgcaaaagggcgacattgtcattgtggcgcatggccacattttgagggcttttgctatgcgttggattggaaaacctctcacagagactgctctcatattggaagcaggcggtgttgggacgctgaggtatgccttccagtatgcgctcaactcgtttaaggttcccaatagtgctgacaacatccagctacgaacaccacaacattgaggaaccagctataattctgggcggtggttttgttgtggagagctagaccggcttcaatcaacgtagcggctggactcggtgaccatgcaagacgcctttccgtaatggtatcgtcgtgttgatagaacatctagccacacaattgtagcctgttcgattcaatctcagctaggaatgaagccttatttccctctggcatcatttcggtcctcaactcggggaacacctctgttgcaaataattaaaacttctgtcagaaaaatagccacgattatataaacgtactcaaaaaaggccttactcacttgaacaaaaaattcatgatattcaagcattagcggttaatcatcccaaatatatcccatagcttcattccccccctcccccccccccccccacccaactattatggtctggccaatcagccgcaatatcattctttcttggtcgctgcctcgctgccgtctgttttcacaccttcctcacccaacaccttggccgcccccatgaacaaaccgccaatgtacccacccaagaaacgcatatcaccagcctggacagcggtcatgcggaccaggttctccgtgtccgccaagtgggcattgagctgcgcgagctgggagtggagatgggcgtactggcgagctttggcggtcgacatgctggatgaggcggccgcggtgccggccgtcgtcgtcgtcggaagaatagagggtctggaaaacgtctgggaattggtatgctgatgagaagatggtggcatcttgaacgaatggtttcttgtttctctgaactggaccgattcttctaaagagtggttggttttgttgacatcggcgagagtgcggggactaattagatccgtcagagtcacgtgcattgtataaactgacatgacctcgagacttctattatgtactgtacatacatacatcccgggaggaaaaacaaattacgcattatgccagggttgaaggaactttccgacctcaagtcaggcacgagtggccacgtgcggcaattttgtattgaattagaggcccatccgaacccagtcgagtcaatcaattaacctaacagatcgaatcctccgctcttttcgtacgcccgggatcaaaccattagaaacagatatagctgggccgaccagcatcgaccagccaacaagaatatcacaagaatggatgatttctggaaagaaaaggcactgacacaaaccaaagtcaaggaagaaacaggaaaggaataccgtatagggggttgaacaaagaatgcgccagtaatgcagaataccaactgtcgtacaaataaaaaggaacagaaaaagacgaggactttcatgtggcggatggtgaaggtgcagtaatggtgagcgtgatgcgattatatggccagcaaacccttgctgacctcgtaataatagtagtagtagtaataataataaagcaatataccgtgaagaagcagagaaagtccacctgcccagcccacaccaaagcaaacggcaagaatatgttccctatgtccctaagcatgacaagaagaagtagttcaacgcagcagagccctagttttcgactcccctttcctttccccaggcattcattagagaaaaagatatagatcatctgaaaccacgagcgaaaaggatgcaacaggtcacgcacggccgtcgtggcctgcaaacatcttttgctgaaaggaaaaagaaaacagatagcgccatgggccgggaagatgagtttcatccgtggcgatgacaccatcgcatcaacaacaccaaattttccctccccaaaaaagagtgctccggattctcgatcgaggttccaagtctagatataaatctgtacgcgaccgggttgtcatgacgcataaaattcggtaactaggttagatacttttctcttaacgaacagacatgggagttgggtgggcccctaggctgatttgactgctatgagccgagttctcggaatcgatattggcactcgctccgctgtcaccactctccgcgctggcgctcgcactaccagtcagacttcttgaattaggggagcccttggctggatatgaattgctcacccctagatgttgctccatttgctgcggtgccaccgcatttccatgcccaggagggtgtctcggaactggggcccgcatattcgtgggaggagagggacggccgccctgcggcatcccgttcggcggtggcccatatgaggaatcttgagctgtagccggtcggcccatgccacgtccaccgggactgaattgccctccgggcgactggcttgttcgcctgctgggcgggtacgggccagggccataatcacccatgcggctggcggtcatggagttcgccctagactcgatgtgcatctcctttctgtccaccgatccatatctattggacgaatagcccatcaagggatcatccaaaagggaaccgtggatggtggggatctcttggatcaaacgggaactcgtgctctttctccctccaccgaataatcggctaaaggatgaggtaggacgcgaacttgagcccgcgctctcagggtttttgcgcagctggctggcgctcggtgtctttctgtttcggcgggatgtgacactcatcatgtcaatgttatcaggatcgatgcctggtggaggacggaattccatgggatcgaagtagtcatcctcgtcgtcttcatcgaaggagggctgaggaggcgggcccctccgaccgcctcgcctcatgttcatctctcgctcacggagctgcagctcgcgctgacggagttgcaactcgcgctctcgaagggcaagttcggaggccgttggagctccgccattgggcatgtctgaggaatggttgccattgctgttctgagtgctgccattgctattctgagtgctgtcgggcaagtcatcataaacgacaagatgactgaattcctccaggccgttatcctcaagggaagtatcgcggggcatcctgttcggagaaggttgaccacttggtggtctcatggggccacccggagggggtggccctcgtctctgcggtgggggaggcattcccatgcctgatgaggttcgactggaacgcattccattcgccatcggtcgctggggaggaggcactgaagaggtccgtggaggtggaggttgagagaccaccaccgatggttgcggtgaaggcgctgactgcggcttggtttggttgaccgtgttgacgtggtgcaacatggcgtataatgtttcaatgcgtggaaggcgcacaccgctttccactcctagtttgatgggagatcctagatatgtctcgacctccatcggtctccgggccatgaaatcttggtacatagtgctctgagtgtcggatgaggcgatcatcttttggatggtcttctcgcgaaagtcactcggaaacgaacagccttgcgacgtagccagctggatgagttcgtcgatcacatccgataccagctgccgtacaccgaccttctccagcaactgagcgtggtttggagtttcgaagaggacgctagcaggatggaacgcaataggcctgtaacagagaatgagcgcccgaccaacagtcttgtttaaggttgacaaggaaaaacgagggtccctaccctatcatgcgctcaaactgctcctgcctaatgttggacgagactttgcaatctacctggcccgaactgagggtgatggccaatgccgaagccatatcattctggatagctgcggggatggaaggattcttgctggcaggtccgacccagatttctgacgacgacccctggtgttcaaactcgctggcgccaatctgcgtgatattgacgttggaaaccagagacagaacgacattggtgggaaaccggtgctccagatgggattccactccgattgtgtttgtggtgttgacgaggatacatgtatgttgaggggtgacgacggattcgatgacggaccccaagtcataaacatcgggtaacgctttcacgcagaggatgacatagtcgtaagcgttttctcttgaggccgcttcctcgggagtgcgaacaactgcagtgacacaaggtatcagcggattgatgacaaacgaagaaagaggcatgatgttcttaccatgacgaggtttaaaccgctcatttccaaacgtcttggatctattttccgctggtcaacgagaattcggggattccgggtccgacggatggcgagatggcctacctgaaagacacgccatattgggccaccgactcgtagcccgacttccagacgagcgtcacatcgcaggagttcgtcgcctgcagcctccaggagaggaaagcggacaccgcattaccaccgactacacagactcttgtcagtggcctgcccatttcttgcgacgcggtggatatgccgaaaaacgaggggtgctagttgggtacgatgcaaggtcgagagggaaacgcgagagagagagagagagagaaaccaaacacagtacctgataagatgcgcaaccggggcggcgtaggggccattctgaaggaaaaaggaaagcgggacaggcgtcaacgcctgcagagacaaacgagcagagttttttttcgaggaaggaggcaccgccagatgggagcgaggcacggaaggaggcagcagagctggcgggaagcttccacgtcgaagctgcctgcggagagcaagcacgatggcggccgcgtcgaatcaccgccagattgaaaaccccgaacagtcgaaaaagaaggaaccggagtcggaagggaccacgggggaattggtaggataaaacgagtgaacgaggggcggagaagggcgagggaaagggcgaaggaggggggcggagacagggagagaacgagggaaagagagggaataggatgggagaggatgggatggggacggtgagtcgactgaggcagctgctgagacgagcgtagcaggtagcagcggtgctggagtcggtagtccgtagtctggtactggggatgggctgtggtaatggcaatggcaatgccaacggcttgcgggtccctgggccgccagcctggatgcggaagccggaacgggcgaacgcgataaggcctcgtccctggatcgatgagtggtgagaaaacagaaaacagacagccgcacgaacagaaaaggagataaaacagagacggacagacaggattcaggccgtcgagacaagatctcgagctcgtcgacaaagatctggcaggtagcctggcggatgtcttagaattcgaggtggtggttgggccactcccaccgccacaggctgaagacagacagctgcaccacgcaactggcagcgtggcctgcccgccgccctatcctgtttgttttctagctgctcgccggccccggcccgagtcgccaggccggtgacgtctgcgatctctgctcccaggagcatgctcgcttcttctggattccacagcctggcaaggccgcaagaagcctatctgaggaactatcgcgctgacacgacgcctggtatctgcgcatcccgctaacactagcagacggaattctcagccagctgcaagcatggtgttgacgtccaaattgggcgcgatcgagttaactaggttggactaatcctgtactgcgcccacttggatgggtcgtggcagtaatccagttgtacctgtacgacatttgcttacgaaactcgattagtggcttgctagggcttggagcccccttggcgatggaacctgagatacgccattgatgttaacaacgagataaggcgggatgcaggaggaagcgtcacagcaggtgcgtgcctcttttcttaggcaacagacagcgcctaccttgccagtggctgatgtttggctatcgtgaccaggataatcccggattgggaaacgccaaaacatccacttcgtcaatactcgatgcgacgtcgaatcgacaggaatctgcgggatcacgtctgtcatagatgtccgtgtctgaatttaagcttgggcggccaccagctatggacgctatcaccgcattacttttgttcctttcctcagtactcggactcaaagctctacagagatagagacttagagagggattgtatctgagttgtgccgatgctacttgtcagtctgccgttgctcctggtaatctctggtatgcaagaggcccgcgtcttcggcagtgataggcaggtcccgcgtcagaccgcagctcagtggctgtacaagcttcagtcctccaccaggatgagccagatttcttcttgtcaccaacctccacgaggaacgcgtgcgcgtgcgtcgctcgcctgcagaaacacgtcccctcttcaataattgactgcaatagagccactccgcgaggtatgtggcttatcaccgatcttcacacaagaatattaattgtactcgtgcacacgagtaaaccctgtctagtgcgaatccgactcgaactgcatctcactggtcgatctgcagcatctgcatcgttattctcatggaccgtactccgaacagagtatgtactccgtgcagcaaagccacagcagcctcttggagtgggcgatcgaccagccgcagcggcgcagccaactgggctgatcgacttgccggctgagcttaaaactcggcagggtgacgatcaccattcgaaaagcaacgcgataaacagacaattctttaatgcacaccaatcggagtaccgttctgtacaccttcctctaccaatccgtataggcctaagatagtctgtgcctgggatattcgctgtcagatcgtgcatgtatggacaccagccgggcagcactgaaataattccacagaatttgaccggcgtagacgactgtcattactcatccgtgtacccactcgctgcatccttgggacagaagggaacaagccgttacacgaggcctgaactttgtggaatcaggggtgctgtccgggagtcttcggcgcatggtaccgattacgaagggagtccaccctgccttctaaaattaagtcaagaagggcgattattgtcggaccggtgaacttcacgcttcaccaaagcaaaaccagaggcattccttatggagcagctaacttggtttggaatcgtgaaggtgcttcacgacgccgttgcatgaggatatccagttcttttgttttctgttttttctttgaatcggggcagcaggctctagacctctgcctaatggcgtctccacttgtccgggtccagtggggattggcgggtccgtcgggaatgaggaggcgaccggccgctgcgtccaggggcgccggctccgatcagaacgcgttggtgctgctaagaataagaataataattcgatcctcgggcccgaccaggctgctagtgctgccgtgtgccagggtgaaggtagctatccactgcgcggttccatggcctcatccaccgtccagcggtacggccagggacggaggataccgtcttccgtactaaggttctagaatgtcagccactgcattgtcgtctggtgaaccagaggtttcgcatcggatgtttctccgtcgtttctcatagcttgattgagctataggtactaacgatgacagctgccacagccgccgagtcgacgtgtacgacgactagggagtactagggttagctattaattaatgatttataaaggtacgcgtggacttacatcaacttggaactcagcatactttagcacagtctaacacgtattcttctgataactatgtatgtactgtacagagtacagagtacatggggaagctctaatattactgcgtcacattcctcatagcaacaacaacaacaaaaaaaataactatccaactccagtcacgagtcacgagccatgttgccacggcccagtcccacatatagtcccggacggtgtactccatacggagtgttatgaaatcatcactttttttttcccctatctttctcttttttctgtaggttctcgaaccgaggaccgagactgggcgggtcctccgtgggtacgggtaacgggggtgctccgtacggagtaagtagttattgttattgagtaaagtagcctctgatgagataatatcgtcgtcatcaaatcaataataaacacactcctgagagtccttgagatgctcagtactctatagcgatttcgtcccgttcggctcgtattttccgtccgcaccgtcaggactaaagacgtcgactcaggacgtgagtgagacagtaaaataaacaaccatcccattcatatgtatagacagatcaattcatccaatccatacatatggttgttggtaaccaaactattaaataataataataatatcatagattctaatcctcctaagactttaattaataatacctacctacctgtttatttaagtaccacacgtcagtgccaggctcgattaatcgtggcaagctggcaaggtatctaagatttgaactatatacatacgagcgtactcttcttactgtaggatatattattatatattccctgctgggttcgtcatcaatatacgcataacataatcagactagcattgctaaatcttaattcagtctgctaccaacttagagtattctgtactctgtacatggatagttagatacctaatataatagtaccaaacaagcaaataatctctgcatgttgacgttgcaactattggacaagcgagttgagctgaattagtaattcttaaagcctgagtgaggcttagataaatagacagcggaagaagggaaagacgctgacaaggcaagtccaagtgatgtgatgtgatgtgtaacctttccaccattgcccctattatataagttagtcactaggacagtatatttctttgtattttgcataatggtgattcctccccctgcagctgcagctgcagccgcacttcatgtcaatttgtaaggatgtactctgtactactgcactatgtacttaacttactgtgctccatcatggcgtttgctagagatagatatcattggatgagtgctgcatatatataacatctcacatcttgattgattgatcatcaattgttgattgtcgtcgtggcgtcgcgtcgcgtcgcgtcgacgcgccacccctttttctttttttttcctctcttcgacttttttttttgaagaaaaaataaaataaaataaataaaaatcttttaagaatccttctccctgttgaatttcctatctcgattatgtgcgtgccatatatttatttgtttgtttatctgattgaaattccatcccatctcatctcattattcattcattcagaaggctaactgcatacagacctgtctatctcccttaattaagttgcttaagcgttctcgctttcgttttatttttttttttacttttggttttatatccctcctttgatcttttatttatctatctttcctatatatatctactgtaagacttgtcatttcaaatgatgtgatgaggtaggtgcaatttaatatgtactcgaaaaaaaaaaagaaaagaaaacaagaagagcagagaaaagaaaagaagagagagaaacacattggaggggaaaaaaagtttttaaaacacgagcaaaaacaagaagatgaaaagaacactacactactacactacactacttacgtatcttggtctagaaggaaaatattgcatgcacatacacatagttaaagcctacagcttattaagatatttctttaacttattacctacctacctactactcgaccaaagactaaaactccttgctaactccttgcttactgctatattcgcctaccttcctgtcttaacccacaagttcaacctataccagaagccttctcgaagacttggacggcgtacctagtcgatactagagtaaaaatttcaaacacagcacaaaaacttcccttgcattcagtaatctaaatagttgtcccatcccgagtacatatcaagacgaatttaaaagaaagaaaaacgggagaaaaaaaaggtaaaggggaaaaaaaacattttttttcagattcctttctgtttcttttctcaatttctgctaagtctccccgcaaaaagaaagaaaaaaatcccttttggtacaatatcgaggatcatcacttcaacgcaacagaggaccacaagttcggcaacagaaaggcgagtaataaatcgaattcaatatctttgaattcacgccatgtaggtgctggcgtcaactccgccctcaggatactcgctgcatgcccgttagtgaagatcactacaattcaaagacggcgaacttacggaagagccacttcgaaacgtttctcaatctccttcaggaccctctcgtcctcctcgctgctcacaaacgagatggacagacccttggtaccgaaccgaccggcacgacccacacggtgcaggtacgagtctgcgtccgcgggcagatcatagttgatggcaaggttgattcgctcgatatcgataccacggccgaacacgtcagtggcaacgcagatacgcttgttgaactccttgaattccttgtagcgtttgatactgcatcaagttagaaactagtcttcccaatgagcgggttggaccaacgtaccgttcttcctggctgacacccgagtgcaccgcgatacttgggaagttgcactcgcgcagcagcttgtcaagctcggttgcgcgcaccgtgctcttgacgaaaatgatgacctggttgaactccaggctgtccaggagatcgttgagcttccggttcttttcagattcgctgagcttaatgtagtattgctggagaccgtggagggtgagtttcgtgtcatcatccacgtaaacctccagcgggttccgcatgaatttcttgcagaccggccggatctcctgtgaaagagtggcgctgaacatcatgacctgcttgtcggcaggcgtggcgcgaaagatctcctgaacgtcacggcgcatgtctgtgaaaagaaacgtgagcacgggtaccatttgagtcatgaagtccagaacttaccaatctgatccaacatcttgtcacattcgtcgagaacgaagcatttgatgttgcggagagacagcttcttctcccgaaccagggcgttcagacgacccggagttccgaccacgatgttggggtacgtgtccttattagagagcagctcgatgtccttctgcatcggcgtgcctccgtaaaagacggcggtcttgacatcaggcaggtacttgctgaaacgcgcgtactcattcttgatctggtaggccaactcgcgggtgtggcacataaccaggacctgacactctccaggaacgggctcgagctggtgcagggtcgtcaagacgaagactgcggtcttaccaagaccagacttggcttggcagaggacgtcgacattcagaatagcagtcgggatacagacttgctgaactgtatgggcgaagtggaatgttagactttgttcgaagcacgaaaatttgagaaaacggaatcgcatcgcgtaaatgtccgtccgtccatcccctcggagtcgcaaactcaaaaaacaaacgaatgatgcgaaaaataaaaaaaggaaaatcaaattccgctcagaagcccagacaagcaaaatccaatcattaacacgatgtgttccacagtgcaatccccggtccaactcgaaaccttctgcaggccgacacgaggacgcactcccatgaagacatggggatttttctgcccttcagacgcctccttccgcaaaagctagcaatccccctttgtggcaagaatttgagaaatcatacaaattcgccacgtcggatttaagggtatgcatggctctcaaaggaaacgaccgacacactcgccgcaggcgaaatacagcgtagcgcaatcttcgagatcatttccccgaagacaaaacaaaccatgggcgatcctcgtgtcgcctgcagggcgggacagaacttttatcgcgcgacggacagccttcccccgcgaggatggacggacgtggcaatgtgggataatggaggaaagcttgcaggagataaaaagtgtgtgtgattagactaaccctccgatggatgttcgaaaccgcaatcggtgatggcacgtagaagctctcccttgagcaggaaatcgcggaaaccggtcgagtggataccgacatagctgcctttcttgtccggacgacctccagtgacggtcaggtcacccttcttggtcggagctgctccgttcgacggagcggcagtggcagtcgtcgtcgtcgtcgtcgtcgtggtggctgccgcatcggtcgtctggagctcctcatcggagtagtcaatgagatcctcctcgtgagacatggtgggttgtgagacgggtggaaaacgaaggagtcagcgagtgttggagaaccgcgactggcagacgcgcctggacacgaagagaaacgccgaaaatgggcggaaatgtcgacaagttccgaaaatcgcggaaccactgggacgcaatcgggtgttttgcaagaatgcttccacgcgaagagatcgtagctagttgagaggggggaagtggatgaaagaaacagaagaacagaggtcgcgagggatggagtgaagagaagagctggatgcccagccgcagcttagtcagccgcctcagcctcaccgtggtcgcactagccagtattggtttagcgcagcgcagtcccgtcgccaccgttgtgtcggacgctgtcattggtgcgatgcggtgctgggcgatcttcgagatttcaagaatcgatggccaccagcttgtttatttcttttaagcggccttgctccttttgtcgccggagtcgttctacaaacagcacaaaagaaagaaagaaagaacagcaaccataaaggatggcgaagaaagggggagcgcagagccaccttcgggcgcgaatatcctatctgcaccgcgcggccgcctatctccagtctgcgcacacagctctccccagaccggacggaagctcagagaacaacaatgcgggggagactacgaccacccacgacaataataccccgccgagggcgccacgaacagtcccagagatcgttgacaacgacaagatcctgaaggaaatgcagcgcgccaaagaaaacgccgccaaggttgcttcattgtctcttccccggcagtacatctcccagatgcgcggggtgtccctgaaaacgcagcttcgcctgccggtcgaggtcaaacgttctttctgcaagcgctgcgacatcctccttgtccccaacgtcacttgcgtcgaggagattcaaaacgccagccgggatcgcaagaagccctgggcagatgtccgggtggttcgttgtacagcctgtggaactgagaagcgcttcccccagactgacaaacgcagcaagaagctgtctgaacgccggaaggagaacaaagaagtagtcaaggaccagtctggggtgtcgtagctctgcagagatcttggtgagcgttgagagaaaacgacactagaaagaagatgcggggtcgcaaggatggacacttgcgatagacctccaacctcggctcccacattgatcgccagccttgtgcttgtgccgcagagtttggagttttcccatccagcagcaacgaggatagaaaaacgcctgcttgcctctcaacacaaaacaggcaagtcatggccctgatatattctttgcggatgtgaagtgggagacgcagtcgacgaagcatcacccctaggacatgccgataatttagcatcctggtgaacaccactggatcccttgtcttgctcgacagacttgcttggttcttgcagaggtgtgcttcgtcagcggcaattacttcgacgctagcatatttacctagttcctgtacttgcaaagatggcataagggagctgagttgagctgacgccgcagcttctccgtgcgaagaacatgatttattacctacgcaggttattactctccggtctgatctttcatatgatccacggggtttcccgtaaatattagcctagtaaatcgagtcatgaaaaatggattcgtcaactattctcaattcaagggcaattgagggagagagatattggatagtctcactctgcctggcaacaatccagaaaaaagattaatattgtcgaaacaacgcgttatgtcatggaggtatcatctgcagaaacaataaactcaatacttggaagttacaaacaaacagagaagctctgtgagttctgtctcataacacttgtctcttccattccatatatatgctcatgccctagcaaagagagatccgagaacataactggaatgaaggtacacattatcagagaccacctgatcgagcagcattgtagaacgaaagaagcatagcaacatgacataaagggtagagaagatcgttgaaatgaacgtatcgtaaatgcactcgattgcctcccaaagtgagtgatgcatgcagggtgcatagagagacagcgagagaaagcttcgtcaaaagacaatataataggtagcgtgagcagaaagtgtatatatgaacaaatctcagaaaaaaaaattgaaaatgacaacaaaaaacacaaaccccaaaattaaaaaaaaaggaataggaactccgatacaccgatcgcctcctattcctcgtcaagtgagaaatacagtcgtgaactgggggaatcctgatttgccgcgaggcatattctttatcagtcatgatatcatttctccctggaagaaatcatgggcaaagaaaatggttaaaaaaatagtaaaaataaaaataaacagagaacatcaaagctctttaggctgaatgtcattacaagggcccctatgcgatgctagctgcgcgcagattaagggcgtggtgtacgtccgcgaggaccaggtcgttgtataagcaattctcttttctttgcgaacaggctttaggcaaagcggcgacaaaaaagaaacgaagagggtatgtaacggatatggcaggcaggaagacctccccgcggtcaaccaggacctccatattggtaaccgaagcccccagggcagcagagcaggagagtgatgaggcgaatctcatagcgcatgccgagttttgaatctgagagggcccgatgatgggtccagactcggtaccatcggtgacaaaccgcgacatgatggatactgactgtcaccgcctgcgtgccgcttgatccaggcgatggtcaagcccctcgactctggcgcgaaacgacttgacaatatctctgatgtgtccgatcttggcaagctcatcctccaactcgtcgattgaggcaagaatggaacgggtacgtgcgatttcggcgtcagcgtcacggatgacattgcccgcacggtcatagctgtgttggattgactgttgcatttgttcttccagctgttcccattgtcagaccaggcgcgttcacacggagagaaagtctgaaggattagggtgacgtacatattcaatgcggccccggatctgttcctgaaggtgatccagctggtgagaaagggccctcaggctcatgggatccagcagcaggcggccctgactgctggcggcgctggcagcccgggagctggaattgctgtcccggcccgatcctcggcctctggagacgttgccagcatgcccgccctggagcgcaatctgctgctgctgtcggaggatttggatctcggaggaggtaaggccaagggaggtatcggggatggaggttgcgacggacatttgggtcccggcagagacatgctctgttacagcgacgaggtggaaaaggcgctgatcgatctggatccagagacaggcgacagacggcagttcatgatgactggagaggcggcagcggcgggcacagcaggggaggatgaagcagcagcggttgccgtcgggaggggggaagcgcgagagggagacggcgagggagggaggcaggaggaggagaatcggagcttaacggggatgtccacactcacagcggcgctctctccctggcgctgaagggaaccggatgactgccagccagggttgagcgaggccggctgggaggacgaaggtgaatcgccggcgcaatggttcgtcggcggcaaagaacgcaaccgcggcggcctgtcgcgcgttacacaggagacagagaacgagcagtggggagacggcggcagatacgcccggcagcgctgagcaatgcaggaactgcgggcggcccctcacgctagagatggacagagagagagagaggaagagaggctggcgagaggaggagggggtgggagaaaagagtagggcggccggagaacagtgatggctaaaaggcggaagaaggcagcggtgggcgtgtgggggatagtcaacgcccgccagcgaggggagacaggcgtaggatggctggcaggacgaagggggttgaaaaaagcaattatggcagacgacgagagccggatcaattctcctctgctggatcgacgtcgagcagtgggctgggcatggcagcagcaattgtgtaggatgcgttccagacgatggctccagaggtgccttaggcggcaatggtgttactggtgtagttatattatcagtggttatcactcttttttctgtctacagcattcaccatcgattcgaggcctgagtggctcttggaccttgcggacatctcgtccagtgttgcccccgcgttatcgcagcccgagtcgagaacgggcggtggcctgcccagcatccgcgccatcgccgcttgtcctgtcgtccattttcttgggcgtgaatccccaatgccatcctgtccgccaccatcgattttttgatttttttttttccctctccagtcctcttccgctgcccaacgtgtgaggctgaagcactgcggactccgggcggctgttattgggttggtgtcgcgcgagttccgccagcgagcggcgactggaggagcgagctcttcgttgcatgcagctctctgggccctcggggctctttgcacctgtgagcttcctacaatcccaccggcggcggctctagtctgctgcaagagctaacgagcgtgtagctttccaaagcttgctctgtcgtcaacgtttctgcggcctgattttacccaagaaaaaaaagacgatccctgcaccgacgcctgaccgtccaacttatcatcacccaagaagacttcccttgagatcgcctccgccatggccaaagacaaggagcgcgccatcaaccccgcacaggcgcagcgaaagctagagaaacagcgtgcgatcaagaagggcaaagcggaggtccaggcacgacgcaatgagaagttggcgcgccgcaacccggaccggatccagcggcagatcaacgacctcaaggcgatcgaggagtccggacagccgttgaggccgcgtgagaagcagatcctggaggagctggagaaggagctccgtgcggtgctcaaggctcgcgaggccctgggcgacaaagcgccacagttcccaacaaaggcaccgcagagggaaaaggaaaaccggagcggcgtcctgggaaagaggaggagagaaggggaccaccaccagtggcaagagagcgatagcagcgacacggacgagagcgttcgcaggattccgatgcccagggatactccacctccgatcccgcgcccgcgaccgaaggagcctgctggaggcgaaggaggaggaggagagcgtcaaccgcacccactgccaccgaagccggaggtgacgcctgaacccaagatcgtctacgaagccgcgccccagatccgggatctgcggaaggaagccgtcagcaagttcgtgccgaccgtcgtccgacagaaacaggacgccatcaagggacaggggaaactggttgaaccggaagagatggaccgactggaaaaggcaggctacgtaccgacagtcccagcccaggcagggactgagacttcgtcggatcgcaatgccaatgtcaatgccagcgccagcactgatccaagcaaagaagaggaggacgtagagaacatgttgaaacaactagaggaggagccggaaccgtctcgtgttcctactactgccagagttgaagacgcagatgatcctgatttgtagtttgctggatctatcttattgaccgacagacttacgccttgcaggacaatgtgcgcatagctgaatgtactgtacagtataataattctctgtctcaggggtcaccaatagacgagtcaggactaataatataatgattgaatcaaagcatcaaagactgatgatcaatctatctccgcttttctatctctttttgataccagagttctctaactgctaacatctccttatcctccacttaaccgcaggcaacatccaaaagctgctagtgaccaatcatgatgacccagaagactcagatccccaaaaagggccaatcacagagccagaggttaaaaaaatcaacaaagaatccgccgcagaaaggggttatttaagaaagttaaggaatactccattatatgtgattcagatgtcttcatgatactccgctccagaaaggatggccagatatacactttaacctctgactctatagagcagtggctactgacactccaacaattagtatgttgactaccaataactatcatttcaaccctgcattgaactaacaagaacaggaaactatctatccagcgccaattaggaagtccttggaggatgtggcgtgcaaggacatcaatcctatatcaatgaatcattagaaagaatagccaatatgttcaagcacaaggtgtttgatgtgacgattcaacttacctgttgtcacgtgagcggtggggaaggcggcgaggcatatgtacggcagaatactgacacaaaaccgccttgcaaacgacctggctcccttcttcttctcctctcttcccagcctagtctcttgtactttagatcgctcctagcgataagaaactgttctattgcctggaattggatccgtcacatttttctgagattcattaatgaagaattgtggtcactgcatagaatgtgaaaagcaatcaaaatagtttgatagtgattaagtttttacacagacattatgaaaaagcattattgaaaagtgtcacaaggttggttcactcgttccttcccaggagacaagaataacctgaggtattctgaatgtaaaagagaagagtaggctgagcgctttgagactgaatgatagaagtagaaccgagtgaattgctatctagtagcctggtccgcttctagttatagcacacgttgagagagaaggactaggtacacagtgggatttctgcacatatttatctttttttcccgtcatatcattgctctgattttccatatcgctgctctgatatttccttggttttagctatgcgtgccgtttgtctgacgcaactatcggttcggctctgcttttttccgtgggttgcaggtattcgccgtcatcggttggctatcatttcttctcttttgacaggtaggctggaaagacagagcagttcgaagaggcttgtagtctggagagactcaggagtctggaaagattcagtagtctgaacagactcggtagtctggaaagactcagtagtctggagagactggcattctgaaaagactctgcagtccagagagactcaggagactgaaaagaccgagcagtccaaagagactcggcagtctgaacagactcggaagtatcaagggaccgatagcccggaaagactcagtagtgactctccagactataggtctgttcagactgccgagtctcttatggcccaagcaggcaacatcaagtggttgtaatagatgtgaagaatgtggtggtaaatatagaggaatgatcatattctcagtgcagaattaatcaaattcagcagatgtatggctgctatggccatcaagaatcagcaggcaatatctgcctgctgtacaagctttagtatgcttatcaaagacatttcttaggcaaagcatccatagcttattagtggtccatccattattgctagtcccaattgcccaaccctttggtagatctagataccaattagattggtgattcttgctagcaaagatgatcattgggggtagggcccagccagctgcgttgactgcctcaatcacaatcacctattcttgattccctggttatattactttaggctggcccctagattcagagccagtaacaacctttgctgttgatatcatgcctattgaaaagccagtctcatcaaagttatagatatcctgtttagtaatgccatatttttgtacaacctcaagaacacgctgaaaccactctttaataagctttagatccttacatagagcctgttgatgatcatatctgcagctatttttggatttgagctcgtggtggcgattgataaatctttggatccaatactggccaacagtagctggtgcatttaaccagctagatagtaatagactggccatatctcatataatggtgatttgtggtggtagtccctgttggtctatagataatatctatttggcaagcatagattcttcagcggtagtaagctttttgctgtttggtgttgcatctacacatgcagtacgcccacatagcgtggtagagtgttggatgtggcatatcatatgcctatgcagcagcccgtatgcttttaaattgaccatcattgaaagctttaattgcaagcaagatacggccctcttgatgaactgctgaatctgctattttgcatggcattttggtggttgaagttgatgagcatgtcgcgtagtttggtggggtgtttcgctcggtgattgattacgttatgacatctcacgtgtaccttccttatttggaaaggactcagtttgtctactactgaggtcggtgatgtctttgcaggtctctttctttctctctctgccttcgaatctcgctcatcgaccgatatgggagtcatgggttgctttccacgcggtcatcatgaattgcaattccgtctgcatacgccaagccaacaggggccttatctaaaagcatgcgataggtggatgggcgctgctgcctaaatgcggctgcaggcgtatatatgaaagtgaggtcctgcattgttaatgttccctctatcaattgacaaaaatcatagtacatatatataatgtgtacatctgaatgctcacaatggaccactcccatctcaatccgccctcattttccacctatctggaccaactccagagcccgcttttctcagttctcccagccgaagtccgcagcgagatcttcgctttcgcgctgacggactttgaagatttgagtgtcccgtacagcaaggagacctgctatcgacgccccggatacgatgccccccgtcgtacccggaccgaattgttgcggacatgcaaaagagtcttccaggaagcgtggtttatgccgttcgcctacgctgaacacgccctgtatctgaccagcccagatcgagcgccaaggcggcatatcaccgtcgaaagaatgcagcgctacctcgacatcctgcatgcctcgcggagggaagacgtcaagatcaaccacgcccggatctttgcccagttgtgggccctcgagcctggtgatcggctgcaaagggtcttgaatatgcagcacttttacccaaggagaatcactatcacgctgcggtacacagacttctggtactgggaagccaacgaaccgctccgggtggcagcgaaatgggtgaacatctgccggtttccaaacagcctcaccaggctgagcatagacttcgagagcatcgaacgtcgtaaggaggaagtcaattacatcgccaaagaagcggccgaacggtggcatttcagacggcaggatgggaccgtcttgtctgcctgtcaggccgaaacatcgatcatgaaatggaccggcagctcgatctggggaggccagcgctggatccgggacgaggtccgcccgaacgagctcgactatcacgctgtgactgtgacgtggaggcctgccccctcggacggagacgtaccagaggagtgtcctgacctttctgtcccacggacgttcccaagaccgccggttcctaatcctaaccgcggcgaggcatggcttgaactggacgatttgcgcgctgccaatgtgccgcccgatgcgacggcggacgaggcctatgccgctattgtggagcttcacaggcagaggcaaagagcaagacgcgttcgatgaagaatcgcatgatcatgtcgtcgattattgaagaagcagtgcctgtacaagctgttctccacgacatgataccccttacaagcactctcattcttgagtctgtagggtttgttgcattagaaggctgggaaccatttttctgccatgttagcagattctaaagcactttgtcacacgaattgagttttgtattgcacatatgtccagacgtacatataacgaaccattttcggcatattgatactacagtggaaggaatttgacgagttacctcgaacatgtccgaattgattatctagttatagtgagaacttcatgtatcaaggttctggcatacactattgatgcaggttcggttacatgatggtctattctcaggtaagtcatgcttatatctcttatactatgccatataactagttaacaggttaagtgcagtcattatccaacaattgaatgagactcagccatatcaatgtttctttctgctctaactttaaaacctcgaaatatcggtcccaaacagtcggttcacaatccaccggaacaaaatccgacagcggttgcgccagctgagactcatgctcagatacgcaagcttccacaccaaccaggctgtccgcccccggagaccctccggcaggtagccattgatcttgcgggcgccgttgttccaccgatcgtgcgggatctgcatcagcgcgttggcgtcgccgatgtacgccagcatgcccatgttgcggaacgagaaattgtcagtcttctccaggtcgcgcttgttcagccgctcagccagccatttcgcctcctgtttcgccgcctgcgccgtcatcggcggcgcccccgtctccagcatcgcgttgtcaccgatcgcgaacacgtcctgcagcacggccgtctggccctgctcgctctcgagctgcacccggaaatgcccgtccacaagcagcgcgcccgttcgcggcgccttcttgacgtgccatgcgccgctgctgctctcggcgacggcggacggcggctcgccgctcttcagcaccacggacgacgtcgggaactccttcacgacgtccagggacttgatgaacttgttcatcgcattccccgtcgcccacacgcacaggcccacgcccacttcaccctcctcctgcgtcttgagggtcaaacaccccttggggtccatctcatgcggcccgtccgtgtagggaacgccccagcggagctcctgcacgtggtgtgccgttttgatctcaatgccttccttccgcatcgtctccatggcgtatcgagacagcgactcgtcgaacatgctcagtactttcggcgcaatgtcgtacagcgtgatgcgcgccttgcccctcagcgccgggtagagccggtccatgtctctgacgataaagtcgcgcagcgtggccgccagttcggtgcccgtcgggccggcgccgacaatggcgaaatgcagcagataccgctgcatctcctcgctcgtcgtgggcaggatggccagctcaaagcactcgcggacccggcgcttgacgcgcttcgaatcgcccacgtcgcggaagaacatggcgttctcgcgcacgcccggcgtgttgaacgtctgactcatgcacccgacggcgatgactagcttgtcgtacgggatctcaaaccgctcggcctcctcccactggcggagatgctctttgccgcgcttggagcccgtatcaggcccatcgtcgatctctcgctcgggctcgtcgacgcgcggctgctccgtgacgccgctccggacgatagtcggctcgcagatgacgaccttccgcttgaattcgacggcgcgggccgcggcctggacgaagtcgacgcgagtcttgaggtcacgcacgggctcgacgatgctggagaagtcaaggtttccggccgcggtcgcggtcaggagcggcgtgaaaacgaagtacgaccggggggaaacgaccgtgcacgagtactgctcgtccgacagcctgcgcgagaagatgtacccgccccagccggacccgagcacgacgaccttttcgcgggctgctggtcgggcgacatcggggattgcgctcgacccgcgagtcgagacgacctcagcgcgtctggcagtagttgtggtcaggaagcgcgggcaagtttttctcccccgtgaggagacctgcgctggagcgcgaggaaacaataataaggataatggtgatgataatgaaggtagcgacttcatgtgacaggaattgaattgaagtgaactgattcaactgaactggattgaattgaattgaacttgaaacctgaaatcaatcaattgaacgaaatacaaagaatttagtataactaagaagaaaggagggaaaaggagaatccccgtagaatgagaacgatttataaatttgtttcgtacagagtatgttttgtacagtacgtttagtaagtaagtagttagtcattcaatacaacaatacaatattaataataatattagaacagaataattatagaatcaattgcatctgcatcctgtattcgcgtatggatttgtatcattgctgcgctgccctgtgctgtgctgtgctgccctgtgctgtggatgctgagttgagcacatgatgacctcataattattgtatcggcgtacccggtctgaacctgtccacttgtcttctttgcccgacggtaaatgaatggccccttttccctgtctttttctttacgtgcacttgatctgtacatttcctgtaaatctgcagtacggagtagtaggcaaggcagggcagggcaatagtatgtgctgtacacgtatgtatgtatccacagccacaggctattagtcgtatgtattaataatacctagtcgatgattgacagggtggatattacattagtaccttactccgtagtaggtagtatgtaagacagtggagcatatataaatccgcgcccctccgcaggacaagacgaaacaatatgcatttcccgagtcgagtcctcccgacattccttgagactcaagacttgacttgactcactaatactgcgggaaataatccctagaaagatgtatggatgtatgaacttcggaattaattgataattaagctgagtaattgattgattgattaacgagtttattgtgtttatttaactaactaatcatccattgtatgccgtacatacatacctatttgggtaatttgctcctatcggatgtgactcgagactcagaccagtacatgtacagtatgtacatgaacctgtcattgccagaaatggctacatacgactcgctcggaggacttcgtactatcctcgttgtccattgcagcgaagatcggattcttggaacagtatacataaaggctagccgaggagtacatccggatggcccgcaagcaatcaacctgatcatcggcgtacccagcaagactcccaagacaaggggctttttgcggcattttcgggacggtcatcatctggtcccaatcctccataggggataagtggttctttccacccacttttgaacatatatctgaagtagggcgaagccaacatttaagtgactcgaaaaggagactcgcatctgtactccttgtttgttgtttcagttatcaccaacaatgtcgatgtctcatctctcatagcgcaggggattctggaatgagcaccgtggcgtcattattatctgcggtgggagaagcctgatttaaggggttcaacctgttcccatggaactaaattcccctggcgtgagggtcttgtcttggtggctaggaacatcatcaagttcaggttcgacaagctttgatttctagggggtcaacaggcttctccatagctggttgtcatttgcttagctttcttcagtttcatctttgtcttcgcgttcactcaagaaatctcgctctggaaatagagattgggaataatgagttctctcaacttctgacattagcaaacacagagacgccagaggcggattttctgagcttttcatcccaaacagcgatgattctgcaagactaacacaacctcatgaagttttctccatcttgtggatagctgaggtaacatcaagagtaaggtaatgttttttggtgtttcaggaaaatgactgtgaacttataataataataattgaacagttaggcaagctgcaggtcatgtcagactgtcatagttgtctgtcataaaacacaaattcacactatttcattgcataacttatctgaaaggcctaaccaacatgacagatatcgacacgttgcacctcaaagtatggattgtctcagggttcccttagcccatggatgtgctttgccctacaatgtcaggtcaaaattcggtctgatttccagtaatttctggacctccgatctggagcacagctacccagcatgtcaaccagctatcacacgccttctctctgtgtaccctaggcatgggcacaaggccttccgaacatcaacgtatttattcctctcattctggctttcgcccatacacaacatagctgcaatcatatcagctgcacgacttctgggtaaatagggcattaatatgggacgtacaagtcaaataacgcatggatgttgcgattatgagcgtcctcctttgtcttggccgccagcacagcaacttcttctttggaccaggcttcattccgggtcaggacagccatggccccagcctcgtaggcttggtccccttgcagcatcatccaggttccaatctttttctgaagcaatttttcatattagctcgataataccattataccaggcagaaagaagtaacgggggtgtacgaacgtaatatggatcttttggccaggtacccatcggggcgcgatacttatgaacgtggatatccacgaatcctgcctctcggaaccactgttccagatgtggtcccgggctgccttcgtagccattcttgtagaatgcgccaaccatttcattgaaataccgctcaaaggtggtaccttttaaacttccatcctcggagtagggatactggttccagtcttggaattcgacccagccaccaggttttgcatatctaattataatcaattgttagcctgtataaatatcgatcgcgtagaccagctaggactgttgtagtttcgttctttaccgataacactgtttaatcaatccgggataatttttcatcgacaatgcgaggtaccgggcgtggatgaagtcaaaagggacgtcgtagccccattcggcttcgatatcgtcgaccacgaattttagattggggggaaccctaaggtagaggagatatcatgttagctttggctgagcaaatctgagacatgtgatggcactgacaagcgcggttgcgtgggactcaggtcacatccgatgacctatcctcgatcagttccagatcacttaagggcgttatggtgcttgcctcagcagatgggaatcgatcggctggtatgacacaagtggtgagcatactgtacgaaatccggtataggataacggataacataccgaaatccatcgcccatatcccggtcccggtcccaagatctatgactcgctggggattctttatcggggcaagaaacaattccctgttcatcatagtgaggaccatttcatggaccatgtcgagacgatcggactcggtctcgtcgttgggcaggaggtagcctgttgtttgacgttttaatcttgttgccaaagctgtaagatagtatacatgcttactcccatctcgaaagccatgataccgtctgccgttctcgtatcggtagtccaggacggaagatgtcagggaagcagtataggttgatctatataccaagttagaggcgctctggtgatgattattgtatagtagcaatgagaggaaggttctgacttacagttcgtcaccgtaggaagagtcactctcggtgacctggagtccagtcccgtcagaaaaggatcaagtgggatggttttcgctttgaggttacgggcctgcgtgtcgacttcgactggagcaggatcggtcggattattaggatttccgggattgttgggcgccattttcgaagggaatatcaatcttgcggttaggtaggtatgatgatgaaagggtaggttttgagttggggggtacggagtagatagcgctattatattagccattgtaacgaaccgacgactgcgcaggtgctcttaccagataaaacaattacttatttaggtaagtactagtgttataacaatccccgcttcttcttccctgcggaagcatgataacgcttccgcgggaaacacatgcaccatgtggggggttgacatcgatgggcatatgttacacctatcatattcacgggagatctgcaaaaccactgccaattccataggaaataagtcagcaggcattccgaggaacttccatgatttgcggagcaaaacgaagcaacatctaacggtctgcacttttgatctgattggtagaaattcatcacgtgactgtgacttggtttgatatgattggttgaattttgtgacgtgagtgtccagaactaccacctccttcctcacttgttatatggagcccaacctacaagcctacctacaaggctataaggctatagggaggcctatagaatatcataagggagccatatgaagcctacacagagcccctactgagcctataggggagcccacacagagcctacaagggagcctataggagcctatacaaagcctggagcccatatggagcccatatagagcctataggggagctaacataaagccgatagggtgccaatatgaagcctatatgaaacctacatagagcctgacgggagcctatgctgattggctgaatgccattactaagcacttcccaaggacatacgaagtagacgccctaggaatgtatttttatcacgacattaactagtcatgcaaccagcagaagaagaaaatccatccatcagataagtgacttttcttccatgatgatcttcttgaagacttttgtgaaggcatgtttgaatgtgtgaatgtgactcaatattgcttggtgctcttaccaaaggaaatgtatatatacgcgacatcttccaatctccaagggggtatgacggagactaccttacgggatcccggggtttcaaaactaccgtcaggtgacagtatttaagggtttttataccactttataggttttttaaccatctttttataaaagaaagaaaaaagtctaaagatagtcatttgacggtcttttattacaaaatgttagatttttataaaacgttagattttaagaaacgtcagatttagggaaaaaaaaacgtcagattttaaagaaaacatcaggtttggcagcacctaagaaaatatctcttaaccacaaccctaaaaatttagatagcttagacagcctagttagattagtatagaaataatggaaaacctcattttcttcttaaaaggtagaagctttagtttaaatccagcctttattgaataattccttcgtcgtggaaaaattagtggtcgtaaactaattaatggtcaaatcttagtcataaaaataaggaaaaggttattatttttaagacgtctgtctttttctttttaagacgtttgattttttttatagtctagcgagtatcttttattttcagacgcctaaattttttcatacggtcgatagaccgtcgatcgacggtagttcaaagccccgggatcccgtatggtatattagctgtagttcctattgtctagcacgtcattgtagtcttggggcccttattcgtccaatcactgatacatagcttggaagctagtacctatgattggattagcgctgggagatcttgacagaagctaacaggaattgtttttatcatctcagtctaatcgagcaacgtgtatatagaacagcattctcatctactcatcactcatcaatcattcattcctgctctcttcgagcaagtcttgatcatagttcggttgaactaaaggcatccggacggcaaaaaccgccgccgcagccagagacaacagcgctcccgccaccaaatatggcaaccccatcaacgctccaccgaccctcatgcccgcgtggaaactgctcgacacgatcggcccgttggccagcttgccgatcgtctcgctcactgccatggcgttgtacagcatgccgacatgactcgactcgaccagcgaggtagccacgctgagaacgacagggacaaatccttggcccaggacgaagagcgttaaacctgtctaaatcagcatcgctcgacacattgtcagagaagtgaagaactaacctgccaccatcaaagatacactgggcgacagaccaataccaaacacccccaaggccatggccacggcacttccgcgcgccagccagagatccttggtgcgcgcatcgcggccgtgtcgaaggatgaagtcgctgagtcccgggaggatactggtcaggaggatgaggttgagcatggcaccgtaggagagcaggaattcagcctaaaaatcaactgtcagttctgacagcagcagacccactaattatgaatgacgtacctgcgactcgcgccagccgtaccggctcgacacgtactgcggaaggtattcttctatcgacgaccaatacaactgccccagcaacgaccggtacagcgtgcctaccgctgaccggtacaggatgcctacgaagaagaccagcgctagcgggatcggctgtcgtgatgcccagaggaaccgcaggtcctgcagtcgtgacattaatcccgcaatcgcccgtctccagatagtgtttttcaaaacatcatcattaagaacgaccggatcgtcttcgtcgtcctcctcttcgccgtctagtagggtaccctctgccacatcgcctggtttcgcattgctgctagccttgtgcagctccacggtttctgggaggaatatccacgccgtcaagacggcaataaaaagcgccgccagccccagtcgagcaaaccaccaggcttcgagctgcatcgaagtgagagaagatatgaagatctcggccatcagggcgacggcgtggagccagatgaagttggaagccctggacatctcagcatatatagcgaacctaaaggcctcgtcttgctgctcacctctgctcctccgacgacacatcggaggcgacaacaaatatcatggaaattcccacgatgggcccgccgcccgccagcaaaaagaccgatgacaaccatgtcaacttgaccgggaagacatccgaccaccacactaaaccatcaacatcaggatctgtctggtgagtttggggatactggcaacgtacacactatctgagtccatgcggttcccacagtaagcccggcaagcgccagcgcgagcacggggcggcggccatatcggtcggcaatgacaccatagaagattcccagcagaatacctagattgtagcacagtcagtcatttgcactaccagcatggcttatatattctgcccacctggcagacagtcaaacagctgctgccaaccgatcaacgcttccaacgcgctctgcaccggttccacgctgcagtcccgaccgagagaccacccgggaccatagtatgacttgcacagggccacctccttgagctgagccaagggcgcaaccaggagagcgttagcaccttggatcaggacgatgaggaagaggcagatgttgaagacgcgtgcgggacgaggttgcttggcttgatgatcagcggaggcagcatggcgggggtcggcccctgtggacgagagcagcggctcccgttccgacagtgcctgggaagtggacgtcatggtcttgagaccggacgaggatgatcctgctgcagctgcgatggaaaataacacatgaggcacgtcgtgacgatcaagcgatgatgatagttgtgatgatgatgatgatgctccgatcgccagcggggccagaagggtccgatctccgacgggagttaaactggatacggagacacgtcaacactaaggtaaggctacagaagtgtctacgacaatctacgtaatacacccagaaaatacatgtatatccactctttcgaagatgaattctccatcgcaccttagcgatcacgaatctcccaggaggccagaactccccaagtcgaactccgacctggtgtctgtgtcctattctggaatagtgcggattagtcatctccacacgtggacggtcatcatcttatcaatcttctttaagtccagactgacgcggctttggctgcctggaggcctccctccgatttaattcgccccggctgccatgaatccctgtcttctttgcggggaatcttctcgtctgttccaaaccataatggaaacctgatttgcgtgtgagaaggcaaaggtgtacgtatgaggcgcgcggtgtcgccataaaatggctgcctggtctgtatacgtagcatatgcccgtagattcgagaagagaaagggggtagataaataagagaattctcctgtctgtctgtctaattattttttatttccgtctcatcattagtgcatagctcgattccaataatttctcatctgctcatcgctaaacagttagcacattatcttgacaagaaacagagaaaaatggcttcgatatactacctcaatcaacctccccatccggcttgggatttcctctccagtctcgaagatcaccccttctttgctccttttttccgcggtccgcttcatcatcctcttcctcacttccatccttatggacatcatggtcatggacctggtcacggtcctggtccccgtcatgaacgcttccaggaacgctccgggaatgagaatgagaacgtgaacgagcaagctcctcatcgggcagctgccagtcctggcaatgaagcacagcaagacgatccatctcaaagcgataatgctgctcgtccgactcgtagtctaggcgaaaatgcaagagaaacttctccggatggtttcactcatggcagaagcggttggtgccgtggaggtcgacatggtcatcgtggctttttccatggccgtgagcaccccttcggaggatgtcccgccggctttggacctggaccttgccgcggtcgcggacgggatggccctcaccaccaccgtggcggtggcagaggttgggggcatcacccgcgtggtccttttggcgtgccaccccccttcatcgatggccagtttgatttgcactccttcctcgaacaactcggctcccaactaggtatcgacctcaaccagatgtggagaggatacaatcagaacgaccaagtggacttcgtccctcgagcagacgtgttcgacacccccgcggagtacctggtccatgtctccctgccgggggcgcagaagcaggacatcagcatcaattacgatgtcgaagactctgtcctccatcttgctggagtggtccaccgacctggcatcactgaagagctgaacgacgcccttgttatcgacgagcgatctcgcgaagtcggtgtcttcgagcgcaacgtcaggctgggcacccgcaacgaacccgccaacgtggacccggacaggatctcggccaaactcgcggacggcatcctggtggtgcgtctgcccaaggtccccgtggaccctgaatggcgcaaaaagaaagtgtctgtggaggcgctggacgagaaggacaacaagcaggcgactgtagaggatgagccagatgagtcagatgccatgcacgtggacagcgagacggaaaagggcgattttaccgaggatcacgagaccatgttgggtgaaatcactcccacacagacatcagaagacggagattatgacgatgccaaggaatacgtcaaagtggacgttgagtagacgtcatgttgccttttgtgaagagttctgggttgctgtcatacctaaagatctgttcaggttagtgttgcgtctattattattagttcattgcagtttggttagttgtatcgtgataatgatatgctcttgtgactcttttctcgtcattcaccgtccacttcattccataagtagctagttggacagttctgagagacttcttgattgcaattttctagtattaatcaacctccatcatcttgaccgtctggttggcacagttcctagtgcctcggaaatgcgatttcttcgccgtcttcaaagtttcagagagaaaaattaaatagaggataagctgttgaaccagaggtgtatatctaattgtatagtgatgtaaaacgatggtagattggagaggtatagaaggagaatagttgcaaacagacgctggtaggtaaagagtcaaaggaagccactggtagcaccggtagcagactcaatctgaggattgcttaggtgcctacctagggacatgtagggagagagtttctccgtacctcgagtagtatgggtcaaaaaggttcgacgtatcttactacccatgtcgatgttcgcaaatgtctcagtttcatgatctgcgtctgactgcctaggcaggtaaaggctcagttacagaatgccaaaggagccttatccgtgacatggtagatctgccagccacaggcctgttcctgacccttaatagcggggcccggtggcacagtggagccggacctgcaactaagctgactaagctctgccgtctgtcttctgccaaggcgggatggcttgtggggaagcggaacgagtgcgacttgggggcaagttcatttcgattgcacttctagcgattgcaagcttggcgtgcaggatcatgtcatgtttaatttaagactgctactaataaaataacgtttcagtcaccatcaaccttaaacatgaaaacctgccgcctcgatcatgatcgcccccaggatgcatcgaccgacgtcttccctctaaagtggcagagcggcagaggaggacgcaatgcgacgtgaggctgctagcacgtgcggcatgtggtctgaagcaccttcctacctgggcagtcagtttacgtcgattcaactgggaaggttcgaagaagccccatttgcgactcttattctctttgtgacatgcttcactttttctttctttaccacagtagcagttgtgtcgcatggagactgctcgagttgctctggcttctagaggaatcattagatatgaggcaggaggacctgtcagcactaatcccaataaccgctgactgaggcatgcagttcgaattgccagtctcactttctgccccttcagagcggttccacattcaatgaaattcttgccgaaagtgccgtcctcaagtgccgacaaatcacctccttgcagaatagtgaccgtctatgactttctatggttgtctatagattaaaatactcgaaatatctgcaattctcgagggaagattggattctgtcttcattgctcggacaaatctctcaagtaagagtgccgttgaactatagtgaatgtacgaggctcgtataaggctcaaatagttttttctactattatcacaggtactcattccccagaatacctacacaaaaccagacttagctgcatgtggaatgtcattcgtggtgaggagactcgctggagacaccgcaataatatcgcctcgtgaacctgctcgcgattggcgatgtagagcttcatggacctcgtaaggttcctagacaggggccacgctaaagccactgcgacgttgtgagatctcgattcaaccttattcgaccctggccgtttcactgaccggggaaatgtacggaggttccagtccagctgggttgcaggtttcccgctatgcttattcttctcttccaggatagaggactctccattcaggagctgaagatagtatcttctgcctggaagagtggcctcgggaaagtctatataaaggtccataattcgccatccaagcctccctcatccatcacagcacagcagcagcagcagcagcagcaacaacaacaacaacaacaacaacaacaacaacaacaacaacaacaacaacaacaacaacaacaacaagcagcaaagcaaagaaatacagcctctccttctctacagtcgttctttaagaaaaaccaacaccatcaccgtcaaaatgcgtttcttctttgctctccctctcttcctcagcgctgctttcgcgctcaatgcctctgaggccgaactcaacgtcgctcagaacgacctgaacattctgcaagccaatggctgcagcaccctgagtaagcccagccatcgagagaggaaagaatttccggttcactgaccacaaacactgctacagagtgcgtttcctccctggccggtaccaccgcctcctgcgctgctgccgctgctgagctcggtgccagtatgtccctcgcagtgtccttgcatgtcgagagagaaaaggaagaaagaaagaaatggaggctaacgattctctccctacagaccctattgctgaccttgcctgcttcggctccgtcggcaccaccgttgccaacgatgtttgccagggctgcttctaaatagaacgaacgccaaacaaccattggcttttgacctttgataggctttttggtgcatttgaggatggactggttcaatgggaaatatggcccgaatcttagatagttatgggaaaggtgaacaacaggaagaaaacagatatagttggcgggttgttgttgctgattctttgtctttatatttattttttattttttggcttccactttctccccgatatggagatatttgcatagacctgcgcacagagaaatgtaccatatatatcgttgaatcgtgctcgtgtaaacattaaagcaactaagcaacttctgctgaacgtttcataactagagcttacaactccagaaagtggacaattcactctcagaatttttctcttttcttttctaatttttttaatttttttttaattttgtgtctggcacatactcaatgtcttgcatttcgtctgccttggggaattggagtgaagagaaggcatgtgagcgcgaatcacgggattcttgcgtacctcccaatcctccagtcagtcaaaacttcatccttgacagaccccgatggaatcctttcaagactggcaacgctcctcgtgtctttgttttagagccatgaaacgaatcagttctcatttggtcacgacatacttcattctactgacgacaattgccatcccatcttgattagaccgctcaattggccaacttcatgagatgatcattctgcttgcaagtgacattccaaaattaagttcattccttcgtctcttcactgcatatcaacaaggtataaaattatatacatgctcatatcataccattcgtcaagacatgtcctaaatatagttcattgttcattgactttattctctgtcgtgctgattgcttcgcctcagcacaaaccccctctcggccgtgccgttcgtcataggtcggtgactctggctcctagcggtccctcgcgtagccaccggcaacaaactaccggaaaattcggagaccacacttctcctacttctggccgcactcaggatcgtccgaatctcaaaggcacgagacgtgatatctgacctgccggcagtcgaaggcctacgtcttcgatcccatagaatccatccacgaagacgtcgatacgctttgcggctgccgtatctgatatcgtcgaccgaaagagcaagcataatcaatgggatagaaatagcaaagccaatcccgaaaatatacttcaatacataggacagcgggaggttgggattgccatcggcgtgaggaaactcctggacgttgatggcaaagaatgacgcaatgaaggacagcggtaggaagatgaccgtcacgatggtaaacaccatgatcgttctgctctggcgtgttgtccccgccgcttggtcgcgcgcaaaccgggcctcgaacgcattggcgtgtttctgcttgagatcgagcaagtcggtgatggagtcatagatcctttccgtctgtttatccatccgatctacgtccttgacatgcatgtcgataatcctctgttgctctcggaaccgctttttgatctcctgctgagaccgatgctcttctaggtagatgtcacagatagcctcttgcaaatcgaagagcacctgcttctgatactcaagaactgtccggatcatgttgagctcgtcgcgaatgtctttggcctctgcgagaagatctgtttcttgcccgatgtcgagaagcttgtcgacgaacagaggctgttcaccccactcttcttccgcatcccatgtctcatccatgcaattatcctctgtctggctatctcttcgatcccttgacattgactccagattcagagagaagcggctggattgtcggtggtgtttcagccactccgaggcttgagcggaagcaatgttgaattcattaaagagcaccgtctcacgatcagttgcgatgccaacagatgcttcaaacatgtctagaaactgatattccgcatcgcccatcctatggcggtcaaaaaacccggagcatcgaccgctaatgatggttgccagctcatagaccgaacgcactggatctcgcgtcttcgagttgatatcttcgatgatcccgtcaagcacgttgagggggtcattcttaggctgttcccagcgctgtgggaagctggttacaatgagatttttgcccaagatccacatccatagctgatccaccatgaagattttcggttccttccagggtctattgtggtcttgccatcgagtctggtaacggtatactacctgatcttgatcacgcatctcggtgtcgatgtttggatagaagaattcatccagagtcctgcggatgtgcagagacgtcgttgaagacataagatgagctcggatcagcaactcatcccgtgagggaggtcttgacgaacccgaacgccattgaaaggtctctgctcgacgtattgcttcctgcatttttcgacggccctcggctgtttcaaaatgcagataaggcataaagacacaaatgttggacggagggtctttgcaagaggccccggacgaacgactacgtttttcaacagcagacgccggacttgatttgtttttggagtcggactttggcgtgtcattagcggtcttactgcgtctcacattgccctttgctttcttccctgaggcgctgtcctcatcctgggacgggacctccttgttggatttacttccggaagtcttgtgcttctttacgggagtttcggaagctttgtcggaccccgcttgcccattgatgaccacctgagggacagaattttcggtcgtctgttccggctcttcgtcatcccgggtgcgaggcgctcgtggagtgctctggcagagaggcctcatgaactgggaatgtatgcgctggccgcgatgctgttgattgaaggatttctccagacctttgaagccttccacgtcactcgctccttcttcgataaagtattttgtcaagagagcttccacccaggccatattgttggcgggcaaatggatccaccgaaaattggttgccttgacattgtctggaagagtggtgacagctggtttgttaggattcttttggtctctcttgtagaggaggtcgaacacagtaaccttctggacccggttctcattgcggaaatttccaaagtcgacgattgttgcatcaaacgccttgcaggcatcagtggcatcttcggacagtgcttcgacgtggttgaatggagccaaaagctgcacgatatctttcctcttgaatcgcgctgcgcgtaggaagggcgtgctcccgaaactgtcgcgtgtcctggttttcaaatctggtctctccaggagacacttgaccacctctagatggccagcttgggcagcaaggtggagaggggtgatgccgttgagtagctggctattgatttcggcacccgccttcaagaggatgcggacgatcttctcgcatcccttgtcgcaggcattgtgaaggggggtccatccgccgtcactctttgcattgacatctgcattatacttcaagagcagttccacaacgtcctctcggtcatgcgcagttgcaatgtgtagggccgtcttgtttcggcattcgactgcattgatgaacgccttgggtccctggggccgattgagaagcaattccgcgaaatggatcttgcctgtcgcgcaagcccagtgaagcggcgtgcgaccgagttcgtccttggcctctatggcgcaattcgtcttcaagaggagatcgaccacatcgtcaccccagtcgcattgtttgtccgccgccagattgtgcaggacatttcgcttcttgttatctcgcgcattgacgtccgcaccccgggagataagcagttgaagaacatgccaatgattcttccaggcggccatcatgagggcggtccggccttccttatctctggtctcggggcatgcgccatagtccagcaggagctgcacgatcctgacatggttgcgctcaacagcccgaaaaagaggcgagacgcgattgccggcgacatcaacgctggcgccctcacgcagtagatagtgactggcttcaatgcagccccgttcggagctcctcgtgagcccgatgcccagaaaagtgggactgaactgtccattggcgcgagccgcgtcgaggacttgcttcaagtcgttggtgtcattgttctccgctgcgcgcagcaatcggggttcgaggcgatcatggttgtcgcttccgaggcttgacctcgatcttgaccgagacatggtcagtatagctggctatagattcacgcaattgtgtgttcaatccattcaattccagagaccgctgtaccgcaacgatactatctacggtgagcatctccagcaggaagcctgctcctcatgcagacatggtattcaaaaggaaaacgctttgtgttttgccatcacttaataatgataaatgattttcctagtcaatacgagaatctgcagaaaaaacaaggttggcctctggtcatccgtcagacctaaacgcttttcccactaattatgccaccatgccaccatctgtgcaacgaacctcatcaccggggaagcgctatctgccgctctgcaggattagtgtgttgtcgccgtggtgtgatttgccgcgaatctgcaaccatcagccgcaaatacgagttggcttgaaactaaccaataacatttacaaattatagagctagctggctagatagttgttatacagagacgttcaggagtacagcactccacatgatcaacctacagaaatcattgcgatcgcaatactgcacagtatacatagcatagctataggtataagcataatccaaacatgttcatagatgataccctcatcctgtacagacagaccaatttcagctcttctagctctgcatgtttgcagcccagcacgtctgagtaaattgactaattgtatgacacaacgcctgcaccgccactgcagaagacttacacgttcagcatcgtttttttcctgtgtttcttgacacaaagtacggacaggctgcatccattcagatggctgcattcagatccatagcagcagtatttttccgtcgatatattataaagacatggaatctctaggagaggagtcgaacggactgtatgtacgatgggaatcgtttgttagtttggtcgatgacgctattaattacatattcattttatgctttttaagcttttattactgttacttccaggagaataataatattgtgtctgttggcacttctcaaacaagaggaaagagaagagagccttttttttttgagaatagacacgacagtcaggttctgacagtgaattgcattgcattgcggttactgacttcatcaagtttaatattagatatgtttgctcatgaataatgctcatgaaggagctggagctcgactgacatcgcggtcttggtgggtatctgcttgtttgtttgtttgtttgtccgttcgttcattttttttaaaaaaaaatggaagtggaaaacagcagtcgacggcagtcgactagtcgatggaacgaacgttcgttcgagttcattcattcgttcgttcgtccgttcattcattattgaagcctccaacctccagactgagtccatccaaccccgtagggaaaggaatttctgtcaccattaattataatcataatgataatcataattataatcataatcatcataactataattataatttacttacccttggctcacagaacaggttgaaattactttgggactgaatgactgacttatttacttacttacttctcttctcttcgaaggcgcgaatggattaattaattattaggcttacgtacattacattacatattgacatattgaaagaaaaaaaggagggaggttgaattgaattgagtctgaattgaattgagtctgaattgaattactaagatagatatctagataagatttatcgaccgatccatggtaccgtacggagtactccatgtgtgtcccattccgctccgctgtcatgaaatctgaaccctgaaccctgaatgaatcctgaaccctggttgaagacacgggtaggagtgtatcagtaactacctaatttaactggtctacctaggtatgtgcattaacatactagtccagatgacggaattaattaaaaaaacaaaaaaaagaggtactgatataccaggagaatttatgtttatgtttactgactgatatccattgtaagaccataactatactataagtaagcacgaggtatttattgtaaagagtatgagtcaaaaaaaaagaccacaagaatacaataactaagaaaatcaaaacaaaagccaaaaaaatgaaaacaaatcatatccaagtatagcctatcccattatttttttataatccccttaacaataacttataacagtgagtaagtgaatatgtgtgtgatataaatatgcgagacataaatccttctcttttcttttctttttttgctttttgttcttcttgttccccagtttgtcagccagtcagtatacattgatatgatgcaatgcgatgtgatgtgctgcgatgcaatgcaatacagatgcaaggaatgaatataaataaatgcaatgcaatatatatgcaatggaacagataaagtcaacagacagccaagtctttcagtttggacagatgaagcttgctgcataagcatctctacctgtcttgtacataacccacttttggggggccaccgtctgtttgcttttgatgtgaatgattagaatttattaacaacaacaacgacggtggcagcagcacaaacatagttctggatctttctctctccccctctcacttttttgttatattgtactgcagatgtataataatagagccaagcactattattttctttctgtctttgcgcggctgtttgtgtcgagtcttcttttgtttttcttgctgcctaaatcttttttttagttcttcaagaaaagaccggttgactgactggtctgatctgatcagatcaggtcaggtcagtgtttgggggtgtatctcaataaaagaaacacaaaaaaagacagggtagaaatgcgggaaaacgggaaaagcaaaaacgatgaaatcgagcaggtcgagatgcgagatgagagacgcaagatgcgagatgcgaaatgcgagatcagatcagatcagatcagatcaggtagtatgacaaaactgcgatatagcagtcaaaaaggttgaatctaaccgaaattacaaaaaaaattaggagagttaactcccatgcatgcactaggctacaaaagaaatcaccgaaaaacagagaaataaaaaacagtaaataagacatcagacccttgtcagaatctggctcatgctagaatataagacgataaataagcagcaggtctgctggcttatttcttctttccgtttggaatccccttgaggatgtcgtcgaaactcatgttcgggttgtgccgaacaaacggcttcgtcggtggctccactggcatcactccggccggcaacggcagggcttccagtccaggatggatggatgcgcgattgcccggcgaactcgtgcgaggcaccgccaacggcgacaccccgcccgcggccggctggatatcagacatggacccaatggacgactggggcgccggcgtcggggccgagaacaacgaggccgcatcgtccgtcgtgatgggcgacccgatctgctgctggcccttctctgcccactgcgctgcgacctgccagcagtggctgcgccggtagatgccctcgacgccgttcgtcaccacatccgacggcagactgaccacccctgccccgttggcaacgccaaaccagctgcgtccggtcttgggatcgttctgcgcccacggcgctccgccacgaggcgccacgcagaggaaatactccaccccatccgtatacctcagatcgggcacgtcgaccaccagcagcggcagcgactggatgacggcatacaggaagagccactggccacaccggttgtcggcgatctcgtcgatgttcttgccgtgcgcgctgcgtcgctcaaactgcatgaagctctcgatgaacggcgtcggcttgacgctctcgtgcgtataggatgccatcaggatttcgttgatgtcggaatctttgagcttcttttgccgctccttggcttcggttatggggtccatgggtttccggcgtatcgacatcaggctggggatctgcgggatatcgaacgggatcggcggctgcaccggcggcgtgctgcggtcatactcgctcatcatccgccgcatcgctcggattatcgactccatcggatccgctgcgtcgagatcctcgctggccatgtccgtcgtccgcgtcgtcagcaagttgcggtccaccaacatgtcgtaaagcgccgcgaagtcctcgtagacctccttcaagaggagccggttgagcccgctcccttcgaattcgttcttcttagatccggccttaggcggccacgacccgtatttctggcgatagtaggaaaggatgaacttccggaacgagaggaacgacgctttccacgctttgaaccgcactactttgctctcctgcgccgtgttggagttggcgatcccagcccacagggaggggaactcgaaatcctcgagcttgcctcgcatcaccttcagccggttctccaggtcgatgtagccccgttccagccgctttcgtgtgacctcgctgatgagctcgaacttcgggctatgcagttgcttgaggtcatccagcttccccacgccgtggacgaagccctccagatacagaggataatatcgcagctgttcgccgaggacgatcgcttcgatggtcttctcccggctcttgcggacgtcagccaggtgcagctcgtcgcagtagttggcaaagctggtcgtggccatctcgccgaaagtcgacccatctaggttggagaactcgaaccggcgtagcaagaccgacacctccatcaggatcgaaaagagggtcggataccgaggtgtagcgatcaaggcctgcccgagtaggaaggcaaagagattccggaagagcagcagggtttccgtgtcttctggcgacaggcgattgtgaggactggagacatcgctattgaggggaattggcaggtagagatgaagaggctcctcctgcggctcctcgactagggccaaccgtgcactcccgctgctggcagcgtcattgtcagcccactgatactccgcagacggagtgccatcgggatccgagacggtgaggctgcgtgtcgactgcctcagggcttccaccttggggtcggtacctcgagccaagtaggtcagcgatggcgagtcagcaaagatggccgagtccaccttgaatgatgggggtcgacgggtgttctgcgggaatagatagacaaaggtatcgccctgctcgttccacaattcggtgatctggggagaatcggcagagcgtcagcgagcaacaaccaaacctgtcaatccagtcaaagtacgcaccgcttcccccctggccagaggaccaaggtcataggggattttctgatccagcccggcaacccaggcctcatattcgtggttccgcatctccacggaagggcttcgtgactttcccggcatccagctccgtcgtttccccgcgcgttctccgggcgtaccaggtcgtgagggaggggctagagtgcgaggcgtcagtccagcggagctggaaggtctactgcctgcgtccctgctccccggtctgctatcgggaccactgtcgctgagggtctgattgacggcgagcaaggaaggaggaggcgggaggtcggtcaggtcaaacggctctacggacccggagcttgttttggggcgtgattctgcagaatgggggaggggcgatgaagcatggcgcgccggtcgtgagctgctacgagcccgtccggtgtgttgaggaggcagatcaggagaagtcgactggtcggactgctgcttcgagctggagccgaggttcaggagggaggagatgcggcgcgctgacttgaccggagcagacagcatggtggcagccaaaacacgtcaggtaataatgtaagacactgagcctgcaatgcacggcaaggcagcatgggaggctgcagggagaacacagctgatccgcgcttctcagtggcggacggatgggccaagacgaattccagcagcagaactgggcttgctatgatggtgccaagggaatggatcggcggcgtggctgcaggaaaaaaaagggagagacggcgctgaatgggcagaggaaaggggcaattgcagcaagcaggcaatgtggcggatccagatcgcgaaaacggtcactgacaccagacgagagccttattttagcatcacaggctgtcgagagtcgagggtggctgcaggctcaagatcggaccgagagaacggtgagcagcaagcggcacgtccggatggccggagggagcagaaggtgacgagacgggcgtccacgcaaacagaggaggcacgagcaaggaggaaacagaggccggaagatatcaaaggaagggagaggagaggagaaaaaggcgaggcggagacggggggtttcaaacgagcgaacaaggcttagaggcggctgatgcggctcagatggcggagagaactctatccgggcggcagagctctcgtctcggcatctaagcaacagtgctcagtcagtcaacaggtgaatcgcagacgcagatggcgatggagatggagaaaagatttcaaggccgaccttgggcaaagccaaacggtacttggtcacccgacagcagcgcagccagcccagcacagaccacacgctcaatggaggtgaccgcgatgattccaggccttccgagagccacggccgaactaggcagttgggtctcgcgttcaacgcgcggaattgcgtatgctggccggcgaagcgtgtgtggagagcatcagcaaaagtcgggcttgatgacgtgggaaccgccacgatgactccaaaaaaagaccgctagcgaccagcctagcagtccccggtccatggccgggcctgtgcgcttggctcgattccctggcatggctcttagcctccgaccaggggtagaagttaatacgaataggcctggactatactcgtacgatttgctggacaaggctgctggagacattcgagaaaactgccagcgcatattccgtacgagactgctctgccccgccccctgactcgaaggcagaatacgagaaagatcagataacgagttgattaaaagattggatcaggtgaaccgtggcagtgacgtgcatgccagacacgttggtaggatatttttgctagatcattgctctcacgtgtctaccgacagtccctttgagctgtagacaaatagacaaagaaacccccttttctcaaacttccagcctggtattgtattcagtcctatcctactgcttcttatctagtaggctgggatgggaaaaaaaaattgaagcgcacagctctcgcgtctcacaagacgaacaactcccacaggattgctagctcgcttctgtgaattcttcctgcatcctgccatgctgctaactgcaaaacagaattttcgcgctcagtgatcaactctccgtcctttgatcagccgcactgatcccctcgagtccccagaataccgccccctcatgacctcatcagcagtgacagccccccacacacggacatcctggtcgagctgacactgcccaccgtccattgtcattcctcgcgtccaacatggctgctgcggctcgtccagatggcaactcaaccaaggcgccgatcgatctcttccgcggttggccgaaccctgccctgctcccggtccagtcccctctcccacgcgtctaccgtcgctctctccaacccctcgatctatcagccaggcctgcaatatggcccggacgaaggctacgggccgctgcgccagcatgtggcgcaatggttgacttccttctatgcgcctcctgaccccatctcgccggaccgcatctgcatctccggcggtgccagtcagaatctcgcgtgcattctgcaagtcttcacagatgcagcctacacccggaatatctggatggtcgcgcccacatactacctcgcctgtcggatctttgacgatgcagggtttgcaggtcgcctgaggggagtccctgaggatgcagaaggcatcgacattgacttcctggagcggggtttgcgggaggcagaggagagggcagtgtcccaagggaacacgaaaccggtatgaaatcccttgcggctgtgacatttattgtattgtgcaaggctctttcaagaaagctgctggcaacaaggaaccctttctgactagtttttctgtcatgggggaaagagaagacatacaaacccccgcggccctggaggaagatttacaaatacgtcatctacctgaccccgacctttgccaatccgtccatgaaggtcgtgtccttgcgacggcgcgaacaactcgtccggctcgcacgacgctacgacgccctcatcgtgtccgacgatgtctacgacttcttgcaatggtcctcccgcccagagactgtgctccccaaccccgagaaggcgtttattccgcgcctggtcgacatcgatcgctatcttgatggtggtccaattgatggatgggggaacacggttagcaatggcagctttagcaagctcatcgccccgggagtaaggacgggatgggcagagggcaccgagaggtttgtctacgggctatctcagacgtatgtcttggtctttcatccctggcggagaactccaactacagaagcaaccctctcgagtctatcaacttagacttgtgcatctaaccattgacaaataggggatcgtcgagatccggaggcgctccctcccagcttacggcgacctttatcgatcagctcctgtccaccggtgcgcttcaaaaacatatcgcaacggtcctgcagcctgcgtatggaaaacgttaccaccaggtcatgacggccattcacgaccacctcctgccgctgggtttccgcattccttcgagctctccccctgtggtgggagggtacttcatctgggtcaatctgccacagccattacgggccactgaattggcgcagaaagctttgacagaagagaacctgaagatcggtagcgggaccctcttccaagtgcagggtgaccctacagagggcagcgatgattttgagggcagtatccggatttcgtttgcctgggaagaattcgatctactcgatcaaggcgtgcagcggctcgcggccgtggcgcgccgcatgctggctgccaggtaagccacggtgctattaccttacctcggaaggcggctatttgcgctcgcactcggaggacggagtccatctgccaccctcgtcctgaacgagaatacgtgggcgtaattgacagatgccaagtatgactcggtctccttccaagacgtccgtcccagtcagcgattgtgagctgtgccgtgattcatcactcactttcatgccatacgacggaacatagacacttgatcggctataattgcctttcgcaatgatcattgtagctctgacccttcccaccattctgtcaggggaaaaaaaattctgtgaggcgcagacatgccgtgctttaagtctgggctattacctaaggaataattgggagaccatagctatagcctatagatgcccagctgttatagcggcccattcgattccagaatctcaggccgtcaaacacccaattcagaagttaacatcgtcaatcaagcagtgaggtagattaatgtctgactgaaagaaccgctctatctatttatatttctgtagacaatcaggtcgatggcattcgaatgccgtagtccgtcttggtgggcagcacctgccttggctgtcggttagcaaggatcgggcaggtgtctaagtgtcaacctccttcggctcctggatgaggggaagcgacgtccgtctctcaacttaagtctccttcacaattctctctcatgcccagtgctgaacagcaactagcgagcccctggcgatcctagcgatgcctgtctggcactaggactgctagtgacacacccgagaaagttggctcttcacttgaccccgccaaggaccggattccggctgcagattggtcctcccgacgagacggagcggtttcgcatttcattactggcatcacttcgaaacagtgaacacttttcattaattgcattattgactggagtgtagggaatatagtcctgctattattatgcttgcggaaaaagctttatggttgcctcgcattaattgactgatgatggcttgataggtgtccattgtttatccgcatactccgtattggtcaggaaagataatattggacgtgttgtgcgctactaccccagtgaaaatccaccatggcagctctcccagttactgaagattctctcgattaaacgatagtactctatacggagtgctccgtcctccgtacacatcactgcacgcaatacgggattgtcgagatcggccggacaatggcgatggcaacggtcgggacccgacacaacggtgaacttcggacggcttcattctagtcctgttttcccaggtttgaccacctgtcatggcataaataggaatggttgatgcttgtctacggagtcttccgtcccattgtgatcgcggaaccacgttcccttccctgtcaccgcccaagtgccgaagaatgccattccgtgtcctggacaacccgcgttccccgacgacgactctccagtaaaaatatttactacacgctgatcccgaggaatggactaatagtgtgattgtcagacgtctctgttatcgagagacgcgataaccaggccgccacagcgtagaagacattggttcctgacaggaaccacattccagcatcccgggtgttttcgtcaaccaagacgattcttcatggatatttcccgtctgcaataataatgccaagtttgttctgcagaatggagaagcgagggagattcccgacgatctcccatacctgtatatatgatgatcgatcccagaggaacagcctgcttattccataattccctcctgctgtaacgtccatttttcggaaacaccagccagcagaaaacgcgatcaagtcggtcctcggtggtgatcgaatttcgcccaggagcatctgggacccagtgcattgtggccggaggtgtccgtctgtttcatcttgtcctttgttgctgcttgatagggtgcttccatcgccaatcaaccagggtgtgtacctgatttcctttgcacgcgccgtcccgcgacgaccaaccatccgcagcgttgcaatcccaatctcacccaacgcagctggtttcgccgtttttccaggtttcgtttctcctcccagagaggggtggagccctcctcgggcccggctcgtttctgctttttggtcttgtcgaataaatccccgaggtggctgtcgatccccgactctaggaggtggccttgctagcgctgtgggttcctattgtcccgctatctctcactgccgtttttggactattgatattcagccctgaccaggccaccctctttttattcactccacctctcctggtcagcccgtcaatcacttctgattcacagtctttcgtttttctttttttgtgtggccggcacccacagcacgctttgggagtgcgccatcacccgtcactctctttacttgcagatttccagatttatcgtcccggcgactgtcgacttatatctcccacgtgggagcattttcccgtctaatcgacacttcacacgccatctgggcaaaacaaagccatagaaaagcatcgctcttttgtttgtctctcttttatctgtttttgtcattcttttctgctattgggttcgaccttcattgagcgctaccacaatacattctgcacaactgcacaattgggaaaataatacgaaaacgaaggggtcgatcgcctatatcttcagcactggttgctggagacctgtctgcagagttctgttaacctctccattttctgctggttcagatttcaaaattcgtcgcctcatatcatagacgtcacaaaaatgttgtccagaatcagcgtgttcatcattcgccttctcttgttcctggggttgtcagctttccttgtcgaggctgcgcccatgcccctggacataacgttaacaacaggcacttcgtctagctcgtctggctactgggtggccaatatcaaacgtcagggaacagtcgctttcggcaactcgaccgactaccagatcttccgcaatgtcaaggattttggcgcaaaaggtaagattggttgataataggaccaaggactagactaacgcttgttaggtgatggcataaccgatgacacagccgcaattaacgaggccgtctcgtccggaaaccgatgcggccagggctgcgactcatccaccgttactccggctattgtctactttccaccgggcacgtacatcgtttcgaaaccaattattcagtactactacacccagttcatcggtgatgccctagatctccccgttctgaaggcctcgccccagttcacaggcatggctgttatcgattcggacccctatgacgattcaggctccaactggtacaccaaccagaacaactttttccggtctgttcgtaacttcgtcatcgacttgactgccatgcctcagggctctggtgccggtatccattggcaggttgggcaagccaccagtctgcagaacatccgcttcgagatggtcaggggcggcggtgatgcaaacaaacagcagggtatcttcatggataacgggtctggcggcttcatgtcggatctagttttcaatggcggcaactacggcatgttcctgggtaaccagcaatttacgacgcgcaacttgaccttcaacgactgcaacacggccgtgttcatgaactggaactgggcctggaccttcaagtcggtcactgttaataactgcggtgtcgccctgaatatgtccaactcgccctcgaaccagaccgtcggctccgtgatgctcctggacagcaccatttccactacccagcaggccatcgtcacggcctggagtactgacagcatcccagttggcggtggcaccttggtttttggacaatgtggacttcaccggctccaatgtggccgttgcgggcattgatggtaacacgatcttggaaggtggttcggtggtgtcgtcttggatgcagggcaacacctacactccgtctggtaaatcttccaaggccaagcgtgctgaacaggctctggcgtccctgctgccgcaggccgctgatgcctgtcctgcaccccaggtgcgcacgataacgatcgtcaagactctgcctgtcgccactggtactcaggtagaaacggccgttccagctccttcgccctctgccgtgacgcagggtggcgctgttcctgcgtctgctgtgacttcggcggctggcggtgccgttcctgcaccctcgccagcggcttcagagactactggcgctgctccgatcgttactccagccgcttcctcaccttcagaggctggatcgcccgcaacttctgtgcatggttctgcaggatctgttgtcacctctccggctgccgcctctgaaccctcgcctcttgctgtatccatcggcgtgaacgttcctggtggctcatctgttgcatcctctcccgccgcggctactcattccgcccaatccgccggacagtcctctatcgctatatctctatctctgggactgcctcctgcgacggcaacatctagcgctcacggtggcacttcgacgggcacctgttcgaacgctcccgcctccaaggcacgtatccagaaagctatgaccgcgtcgaccaagccccaggtcctcttggatggccaaggcaaggtctttgagcgttcgaggcctctgtacgaaaattacgatgcgtcctcgtttgtcagcgtcaagtcggcgggagccaagggtgacggtgttacggacgataccgaagccatccagaaggttttggacagtgtcacggagaatcagatcgtgtacttcgaccacggcgcatatgtgatcaccaacaccatcaaggtccccaagaacatcaagatcacgggtgagatctggccgctgctgatggcttccggaaaggccttcgcggatgagaaaaacccgatccccatgctccagatcggccagcctggcgacaccggttcggtcgagatttccgacctgattctcgagaccaagggacctgcacctggcgcgatcctgatggagtggaacgtggctgaggctacgcagggctctgtgggcatgtgggatgtgcacttccgcgttggtggcaccgctggcaccgagctgcagagcaacacctgcgccaaggatccgacgtcgacagcggcgccaaagagcgagtgtatcggcgcgttcatgatgttccatgcgacggagaaggccagcgcctatgttgagaattcgtggttctggaccgcggaccacgatctggacatgcctgaccacggccagattgacatctacaacggacggggtgtgttgatcgagagccagggaccagtgtggctgtacggcacggcgtcggagcacaaccagctgtacaactaccagatccacaacgcgcagaacgtgtacatggcgatgattcagagcgagactccgtaagttgccacaattgccccgatattgagtttcggttcttgctaacggtttgcagatactaccaagctaaccccaacgccttgacgccgttcaccccgcagacaagctggaatgacccagacttctcgacctgcacgacggactcgtgccgcaagtcgtggggcctgcgggtgatgaactcgtcggacctgtacgtgtacggggctggcctgtacagcttcttcgacaactacagccagacgtgcctggcgacggagtcgtgccaggagaacatggtcgaggtggactgctcggacgtgcacctgtacgggctgagcacgaaggcgagcacgaacatggtgacgtcgtcgtcgggcgaggcgctggtcctgcagagcgacaacgtgagcaatttctgctcgaccatagccttgttccagcagacgtgaaaaaaaattaaccatgattgaggcgtatgaatttgttcttggattcttgtgcatgagtttgttctgaaactcttgcctgatttatttttttgtttacatctacagcaagtttcttttaatttctagggttggatctttggttgccgtttcttcagaataacatatttcttccctctttgcccgacatttctttcttgtgtgtccttattattgtcttgcggagatgatctgcgacaatatctgtagggtagattagattaggttaggactagacaactgcattgcatgcatgatgaatttgaaagatgaattgtcggtgaatacagaagtacatggctacttagctaattcgatcgttgacgaagaagacatgaaatatgctgaaataaaagaatgctgtagatctgatttgatttaatcaggagttatccagaccggctcttcattcggcattggagttcggaagccatcccgaagacctgcgccgccggaacgggaagcatcaagtcaatcccgacagaagctctgtcttcattatcttgcagtttttttcctttcgatttttactttttgccgaagttctattacttgctgtattcgaagagatatttgattaattcaattcaattccatctcccaccgttaattatcgtcgacgagttccttcttatccagtcagtcgacttcccctccgcccctccctcgcgcttccttccggaggtttctttcttccagctgcatctcaactctcaccaaagcaagcaagcttgcccttgctcactcgtatgagtgataattaagactcgagaaagaaaatgacatccaaacatccccccttcaaagaagtggaaaactcccgcccgccgtggcgcgaggacgtctcgccgacgtacacgcgcacccgcaacccggactggaagcccggcgagggcgccaacgatggcggtgccagcctgagcaaaaagcacgtcgagatcgacccgtatgctgagggacgggcgcctatcctcaactacaagctgctgatcagcgcggtggttccacggccgattgggtttatgagcacgaggtcgagggatggtaagtaatacagcatatcaaatcgcccctatctatctctcctttcagctaagttgtaacctggcaggcacaaaaaccaacctctcccccttcagcttcttccagatgatcgggttcgacccgccgctgttcgtcttcggcatcgtcgggtcgccgacaaccaaccccaaggacagcctgcgcaacgcgatcgagagcggcgagtgcgtcatcaacatcatctcggagcacttcatcgaggcggccaacttcacgtccatcgacgcgccgtacggcgtgtccgagttcgccgtgtcgggcctgcacatggcgccgtcggccgtggtgtccgcgccgcgcgtgcaagaggccattttctcggttgaagcccgcctcgtcgagacgcgcgagtacaagagcaagctcgaccccagccgcacgtcgtccaccatgctcgtcgtcgagggcgtgcgcttctgggcccgtgaggacgctatcaacgacgaccgcgaccgccttgacccggctattctaaggcctatgagccgtctgggcggtatctcgtacggccggctgacggagatgatggagttgccgcgaccggaatgggccaagttggatgaggaggagaaaaggaagttttctagtcagagttagactagaagccccctagatagatgatagatttatagacgagtagttatagacatcttacgaagtacctgatatgaacgaatgaataatacacatgtaaatgaatgtaacactattgacgagaaaccaaccatcatacagtatccaatgcagcagagtttcagactggccgtttggaaatggaaaatcccaggcatctcctagggatcccagggaaggggggtctgtctctggaagataaatcctatatatatgaaataagaaatattataggaaaattccattgtcaatgcttaatgccacgccgtattgtatgcattgctctaaaggatataagccatgagatagatgatgggggaagagggaagaagaatccctccaactacgtaatgtacatactgtacagaacagtacagggaatggtataaccatacctaaggtaccttaacctacccaagtcagacatgatcatcatcccatgtcactgcccggagatggaacgtccatggtttgtttcctgtcgaaggtccttccatggtggatgccgccgcatcgtacggcgacattccagaagatcttatttttgtcccatggggggggggaatggaaaatgggaaattgaactactgaagtgttttgttttccttttttttccatatgtatgtacagtacatatgccaaggatttccctgggaaatctggaactcctatgggaaatcctatgggaaaactggaaatcccacagaatttcctgtccctgccaagaatttccctgggaaatcctatggaaaatggaaaactggaaacccttatggaaattggaaaatggaaatccatagggaaatcccactatgatttccaaatttccctattagtatggaagggaagggaaatcatatggaaattggaaagtggaaatccatagggaaatctggaaatcctatggaaaacgggaaatccataaggaaatcccatggaatttcctcaccatgcggctagtctacctgaggaccggggccctgagtatgctatgctattctacgctatgctatgctatgctatgctgtgtatgcaacgcagacaatacaggatgatgttgatgcgatgctgatgctgactctgatgctgatgtatgtacaagcagaataatacagacctttatatctatcgtcatgattatcctggtagttgctgttaccacgtaaacgactcctcgacaaaatcaactgccatccccctcccgatattccttcgagctgctgcccgcacctcatccgcaaacgcccccgggccacacaccgacacgaccgtcgcacccacccgcttcgggagcgcctcgtccagaacgacggccgggcggcaccgccccgcgaacatctgtagcgtctcgctgggcgacgagatgatctcgtgcccactcttgggcttggagatgaacagcttgatcgtcagcatctgccgccggttcggcagctgcaggatctggtccatgtactggcgcacccagcccagacactcggtgctgcgcaccgaccagatcaggtagatccgctgcgtcgcgacgcagccgtcggccgcgcgcaggagcaggtcgcgcacgtgtagcaggtggtgcgtgatccctgcgccgccggagaacaggatcgctgtcccgtagctgcccagtgaagaagggccagaggagtatggtccctcgatgaacccggccgtgaacagcgtctggttaggcgagcccttggctttgttgtacagctgtcgcgtcatgccggttcgtgcggcgatgatcagtgacaccgtcgtcggttgcaggtcgctgtcgtagaaccggtccatgcccatgtctttgaaatcctgcttctccagacgggatggactgatggccgggcttctgccagggctaggtccccggttcaaccaactcgacgggtgtgctgggggcgttacgcagctgctgggctcgacccaggcaacggagaacgggtgcgacatccacagtgagatgttcggaaaatatgcgtagacatggctgccgggtccgatgtgaacacggcggggaaggtagaaggtcactcgacacgcttcgcccggcagagcctcgaccctaactctcgttctgccatcccggagtgataaattcaggtacaccaggcgcaagaaccgggcgctgcgttccaaggcccagacgcacacgatgaccttcgcccacgataactgaggcaaggaatccaagttcagatgcatgtacaccccgagaagcgccagcagagccgccagctggtgcagatgcaagaaggtctcgtagaacgcgtgccggattggcgacggagagtgcgaaagcagaaaaaccatcgccaacacacccaccgcaccccaggagaagaacggcgtggtgcggatccgatcgagggcatctgcaaagttctgctcgtcgaccgcgttgattgaccaagccaccgtgtgcgtgatcgcctcgaccaccacgatgcggccgagccaccggtggaagaggttataggtgtcgaaactgacgtggaggagcgaaatgagcggattgttgcgtcctgctaggatgaagagaggcaccatgttcagcaccgccaacgttcctgatcttccacggagttcagcgatcagggctggtttctcgttgacggcataatctaggaggccgcagtacgcaatctggctcgtgatatacagcacgatcaagatggtgtgaaatcgagatgggattgtccccatattgctagcgatcgaaagctgaatttccctgttatgtctctttttccccagcggcgcatagagcaggtgctttttaatcttaggccagagactggacctttcgacactccagaataattgccgtcgccgggaggctgccagacagctgatctggcgcaggtatgcattgctcatctggacgagacgtccgcagaggaccacgactgcaacgaagcccaaagtggcacatatgatccgggtgatgagaacatctcgaggaacgtcgacaccgttcaagcccctcgagtattcaaatatgtaggtgaggttctggtgcgattcgggggcatattgccccgaagaggcactcatcggaactcgagcacaacaataacagcgaatcgaatcggaagtttacgtccagcgcaaggtatgatcgtttatcaactatctctggacaagccgtcagggaggtcacaagtcacaaatagccgcacgagacaatggcagacggcgtcattcccaggggttaaagtctaggaaccttggattttggaccagttgagtggatcggaaggagcttacctcaatttccgaacgcatacaatgcgggattcccagtagttgcggaaacgacaggaatgcggggacgtccgtcgggacgacccaggcaggtatcaatctccaccgtatcgataggaaatgctggctgaagttggtaattcaggggaccatccaacagagctggcacgaggttatgacgcagtcagggctatgcagtctttgcaattccgaagatcgcagcaggatcgacacaggctcagaacacaaggaggaaagtcaatcggcgatctggattagcagacgtcaggttagcatataactcgatgctgtcatccattaaatgacgcacacacttggattgtgcgcaaagtcaagtccagagcgggaaagaggggtatgctcaacggtgtcttcgagctttgctggcaaagcgaaagtaatcgataaccgtcgtagtggtaggtcaggcaggatgaaagaaaggaggcaacaatgttattgtttattgcaggctagctgtgcgcagtggtgaatgaactagtcaagactgatcggacagtgaatgaagtacgttggttatgaaagaaggaatggttggagaaaggcgttgtaacaatggggcaggccagccagctccgataagaattgaattcagttcacagaacgtgcagcatcaagcaaaaggaatggcttgtgaggaaacaaggaagagaaagtacgccccaaagcccagaggtgctgatgaaacctcactatgccagcctgcttgcctcggccaggtggcagttcatggacgtcaacgatgaatagaggaggaaagaaattgaaattaagccatcgccccaggctagtaggtgtcaaggtatctctagccttgccgtcgagtggctgatcgacgagcgtctgctgttcatcgactgcagggtttcgactcgtctcgagtcgcgcgcctatcggggagactccatttaccagcggtcagcatctgaactgcgctggccagcctgtcgctgcagcgtattcaaggacaactcaaaacggtggataccaatacgcagcactggagcgattcaccatgcagatcgacctggtcaacgcaaggattggaacaaattcgtttcagttcaggcagcgaacagcctgccctggggaacgggcagtccccattggccggtgcgttctgcgttgtttcaagacggcggacaagccacgtagccgcgcgtctgattggctgctctgagagatcctcgatctgtgtctaaatcccgatcgcatggttgcttctttttaactactacagggtagtactgttagtcgttgaatcatgacgatggatgataccgttccctcgccaagcctgctcgctccttgcagaccacgctccccgcgtgaagcaaggaccttacagcgtacaataacgatgctattcgcactttcaagggcatagatttaaggctctcgatagagaggttggggatggcagctacactgcccttgaataccgtaactagggatcgagtgtcgctttcagtcaaccctgccagccatggcatctcagaattaaagtgatgaaataagcttaatgtcgttgcggtatcccatgactcgtcaaagcactgatcctatgtacgcgtatatactatttatcgccccatccagccaccgtccactgtaaccacctcgccagaaacatagttactggcctcgctggcaaggaagatgactacccctttgaaatcctccggtttgccccatcgaccggctggaatccgagccatgatgccagcgttgcgattggggtcattgatcagagccacgttcatgtccgtgtcgatgtacccaggggcgatggcgttcacgttgatgcccttggccacccattcgttggacagggccttggtcaattgtgcgatgcctcccttcgatgccgcgtacgcgggaaccgtgattccaccctggaaactaagcagggaggccacgttgatgatggtgccccgtttacccgttgggaactcggaggcgtctcgagacaacaagtaggcaccgaattcgcgagacagagtaaacacggaggtaaggttgacttgcaggacctacagccgcataaacgtgagttctggaactgctcaagcgcagtgggactcatattatatggatatactcacctcatcccaatcctcatctggaaacttctcgctaggatgtctcctctggattccagcgcagttgagcagaatatctggcttcactcctagcttcaggacagcaggaatgattcccttgaccgcttcccggtcagagagttcggctacatggatccatgctttccgtccaatgcggttgacgatctcgtcgcgggttgccgtgttggattcatctctctactttgacagcacacgttagcttgctccagcaaattatcaccaccatagcaatcattagttgcacgtgatagaagatcagttttgtcgctgtgggtattgcaaggattctgccagcaaaaactgaaacaaatccgtcaagaacttatgaaatgccgcgcagaatagtgtgacgacaaaaatgaaaaccagcgtggaactcacctgcaccagcacaatgtctgctccagcctctgcgagggcaattgccatcgcctgaccgattccgcgtgtgcctccggttacaagcgcggtcttgccgctcaaggagaagagtgaagggaacgaagacaccattttgcttgctttttctcgactgagaaaatgtcgagggcaagactaagatagacagcgagttccctctaccagatagcccagataccgctgtggactgcccgtattcgtgagaagtctttttgaaacgaatcgatggtcgagtctaagggcagagatgttgtaaagagtgaaaggaaagaaaaaaggtcaatcgatgtcaagaaagaatgtcaaggcagccgattcttctgatcgatgttcttgtcggcttataccgtgcccctcacgtatatacggaggatgcacggtatgtttgtactgtaagatcagctcaagaagaacgctccactgctaaagtactccgtaaaataacgcagtctataaatcaatgccgctcagcgactctacgtaataatactccgtacacgtctctagaaaatatctgttgtcatctgttgtcccacgtggccgtgcggggcagtgtcaattgccggtcaatacccgacagcggggaggacgtgtcggctaatgaccacacacggcaattgaagaaccaactcatttgccgtcggctttcaaagactcggccaaacgttttccctgcaatccaatcagggcctccgtaatttctgtacaatacggagtctggaatcgctgtattggggcactgcatagtatatatctgctcgtgtgatcgtgtctatggggagaatctctccttgaactgaagagaaaaacttgcttctgcacatcaccacagatcagcagatggcaattcccaaaacccataatgctgcccactgtactccgtattctgcgtagaacattttatgatttccacgcgatctatagaaagtcactggtgtccgttcaatgctcaacgaagctggactgtcttcagtgaattatgtggaatgacttttcattcgttggaaatgactaacaaaaaagtaaaatttaatcgaagaagcgaagaaccaggctcgtgcagttccagatccaaagccccaagaaacgggggaggctgacacaagtgtggggaaagacttcaactcaaccacccaaaaaaagctcacatggttcttcccccattgtcagctctcagcaaaaccggagatggtccgctgagtcgaaataccaacaggactcacttcgaatcgcggcgtcacacttcatccaccgttgatgccattcgagatcgcgtgtggtccgctggtcctggtcgctcgcctggccggttctccaggtttccgcgacagatgcgattgtctcatcgccacagacgccagcaacgtcgcagcgcaagatgctgcttccgcgcgaatcacacttgatctgatactctaatacgtgtcaatttagtccccaatcacgatgggccaagaaaagcagacttcagtcgcaaagcccaggcccaagaccggcccgacccagcgcgtctcgagagcatgtctacactgtcggcagcgcaaatctagatgcgacctgtacgttgaactccacttttatcccccctgcattctgccacggttaactgagaactcccagggacagcagcggcaatccgggaaagcccccttgccagcggtgtattcgagagggtcgcgaatgcgtcttgggcagctctaacagaggtggtcgacgaatccgcaaaaataagatcgccaatgtcacagccagcaccgaatcatcggcccgtcaaacggtccagcctgattctccttcgacttctgcgccatcggacagccgttcattctcaacacctcagtatccgggtccggatatttacgtgaaccccaatgccgcaacgacggatctgggaactgcgaatgacgatgatgcggcgtctaccaccgacagtgccatcgactcggcggtcccgaggaatccatccgacgcatggcaatgtctaaccgggatcgcgaaacgaggtggcgaaggtacagatacacgccttgggcagtactcttctggtggtaccagtggcttatcagctgtcaatgggatcgaggcagctacaaatggcttgcggacgaatcctactggtatcaaggcatacaaactcgtccagaacggctctttggacccggaattggttttccagctggtgacgcgttatggggagaacttccacccttatcttcccttggtgccgagaaagtactttgatcgcagcaatctcgatgcatttgcgaccaacgagaagcatttactcactgccgtgcttacgattgcttccaaagacttggtagatacaccgcacgtccacgaatattgctccaagtacatgcatgagctgatctcgggaattgctgctggtgcggactgcgacgtggaagcggttgaagccctgctcctcctggcggaatgggagccgcagggcctccgcccccgagtcgagcgtgttggaagaggcgaggaggatcgcgccgcatggatgcatgttggtctcgctttgcgttccgggtattttctggggctcgaccgcacgtccttccggggcgatcctgcaggagacgccgagaccgatgcacgcaagagactggcgtggaccagctgctacatctcggatcgactcatctcggtgcggatcgggcgtgccttttggtcccgaggaccgggcccgatgacggggttcgtgagtcaggactttccgtcccttcagcctgtcaaggagggagatgaggactatgcgaagatcatccaggccaccttggacctcacgcagctgtatggcaacgtgcatgatgtgttgtattccgggatgcgcacgagcagccagatgatgctcatgggagattatgtgaagtatgccgatgatttccgcgttgcgatctcgcggtggaaccgggtctggggtaccttggcttgctctcctcggatcaaagtgacattgcagatgtcctacgagtatttgcgactctacaccaatgctttcgcattccaggcggccatatctcaggcattagtgacgaaaccaaagggcggggacgctcattctcagagagagcacttgagggcggctttcagcaatgtggcctcgatgcccgacgctcgatttatctatgaatccgtggatgcggcgaaagcgtatctgaccattcttgtcacctacgttgatccggagaagcatctccatttcatgccgctccgatattatctgtaagatctacgatgcccactcgttgtggttggttctaacactgtggtagatacagcatttacgctgctgtttttctgtacaaggtaggacactttccattcgcgtcatcgatggtgtacactaacggggattttcgatggcaggcccgatctttcggggtcatgactgcgaatgaggaagtgggagtgcgggaattggtatctcgcacaacagaacggctgaagcaggcgagcgctgggcctgatgatataggatccaggtatgcgcgtctgctggagcttctgtggaagcccaaatccgcgccgtccacgacgtcgaccgaagcccggcccaacaacaaggatatgcagatgtccagtagtagcttgcccaattgtgttccggagccgacatacatgcatttcagcccggcgaacgatttttcttggctcgatctggaagcggtcggcgactatgtttctggagatcagatccctggggcaggcgtcctagggtttgacgcctaccagaactcgagcatgtataaccccgggcagtctcgtcctgagacgtggcagacttcattctggaccggcgatatgacgaacaatcttctgttttaggcccgcaatttttttttcttatttttttatggccagttgtctcgacgacattgagtctgctcgcgtggtctgcccgccggaggatctccgagcggcaaccacgcgggggagtggggtatggagctccgctataatattagccgagtgtcacccgcatacctgcgtcgcaagagtcgagtattccatctgctgattgacgacagctgtcggtgcttgcttagccacctctcctatcctgactcccttttttttctgttctttctctcatttctttttctttgttaaatccacctatacctactgttccttaacatttgattcttacattatactacagcctgtctctcattccctatttctgtccctcatagaaggttcccactgttgactggtctatagcataacccacctgtatatagatattagctactaagccctactgcctaggtggtaggcagagcgtgcatagtctctgactgaaaaacgctctctaaaatggaagaataataataataataataatatagatattagctactaagccctactgcctaggtagtaggcagagcgtgcatagtctctgactgaaaaacgctctctaaacttctaattctctataaaatactataattttaatatatttctataaaaattgggtatataataataatatttagaaaagggggtaatttggtagtgttgcacagggcttagtttggcagggacttttgtcccctggctgtatctgagccaagtcagctctgtggcatccctaattagaactaactcttaaggtctcaaaggacttaatgcctcctgaaggattttaatctttttaattagtttgtaggatatgactactaaacaaccccagcccaaaggtcatatgaccaagtacctttggtctgtggctgacatagacctttggcatcagacaccatggaaaatagtaatcaaaatgttgcagggtaactaggcaattaccaggcccagggttcttgaaagatcgggaatgattcgcaaattagtagtaacgcagctaggtgaaagagacctcgagtaaatcagaacctgactatcaacaattgttattattacattacagctgtatgaattgctattagtttcgctaattagtataataacactaatagtatgttggtcacagtatgtttctgtccagatagccactggccttcgatgaacaaaggtagaactgcagatcaagactggtataccccctctactcattgtgttacagtattggatactgtaacaacacccccagcagatgatacttgttcatgacgttttcttaccgctcttctgcaacttcttctcccgtcttcgtttcacagcatcaggtgtgtattcagtatcaagcaaataatcccaccacctgaagctgctggcgtaattcccaacaaacttctcatggtgaaggtcatgatggtcggctccagcccagaatgggaggaaatgatgaagactccacgggaactcatacccactgtgcgcatcgatggcttggaataagcgcagaacgatccaaatgtacattgtgaggatatgtaggtcgccagttatcgcgcaccaaaggatagggcaaccaacagtgccaaatccaagtaccatcacttcaataggtgatgcatattctgccgctaatccaaagggtgcagaatactggtgatggatcttgtggatggccttgtaaagagggccccagtgaagtgcacgatgtgaccagtaatgccaagtatcttccataacaaagaagatggcaatctggtatgccatggtccagagagacgggaacggcacagtagtagaaagaccgaaatactgtgccatagggtggaagagcctgtatcatttttcatgtctggtaagcatacagacaattcatctatgaaatggatcacttaccatatttgaggtagctcaacagtgaagtggctaaggaggaccagcttggcacaagtccactgctcctgtgccgatggcaccttgttctgtgggtttagtcagcatggaaattcaatacattagggattgagctaacttgcactttggattttgtatttccgaaacagtccaagggtgtcaatgatgatccagggtaaagatctgccaaaatagacaatctcatgcatcaagaatgacatgatgcctgttgccagaacatcattctgcatgtaggcataccatgcagcccatagtcgctctgcaacattaaggtgcgcattgtgtttagaaatctcttcgaattgcccccagtatgtttctgggggctgggagagcaaggttgtggagttcctgattgcagttagcattttgatctgatagggtcacggagttcaaaactcacatgtttcccgacttgatgtcgtgaaatgtttcgagaatacacaattgcaatgcagttcttttttctagcagcaatattctctgtaaatttatatcgggggttgaacactggactgctggcaaccaattcgaagatggttgctagaaggaaaggtgtgttgtgatgcaaaagattttcagaaagggagggcggctgtatttgaaggatttggcgcgaagattaattatggtccctaagttctggggccctgggcacatccgagtggcgcaacaataagcaggtacttcccgagtggcgtggtacactatactctatagatcagggattgtgtgcacatcgtagaacactagtttttagggatactacctctaaaaatttccagggaaagcaagtcacggaatttattattttcccataaacaaaaaatatgagtaaatttgattatataaaaaataatgctagaaccatactaggataccaaacatttcgcaaattttttagataggaattataaagccaaacatggtgacatactccggaatatgtatgggaaaaaaggcgattacaaaaatcaattccaattccaaatatccagtgctataaataattatgtgagtaaaatcatcctaagcttagcctgacttttttttgcaaggtacaatgtaaatttgacattaaaatttgcactgaccggtgtctatttcttaataatagaatactgaatctcactcctacggagtaataatgttataggggtccacaggcgttgttatcggacccgattaagtcctatggttcggcaatctggcttccggaatcggctgacaggagagtcccagccaaaacacctcggaacttggcggagtccacgttgcgcagtacagtcagtcaccatggccatctaaccatccatgtttatactttgtactgtttattgttattctgatacagagaatgtattgaatgtcattagaagacatgaagcagtacataatatttgagaatcgatgacagtgcaatataactccacagaggtacggagtatgtgaaatttaagacactcccatgcctttgcaacatctgctttcctaaagaggttgttgtaatggacaggacatatttccgagggttgtttgcaaggtttgttaaaaatgatgacgacatatacctccctacctaggtaccaaggtacgtactccgtatgtatgtagggagaattacttcctgagcgtccgtttatcactactcgccaggtaatatgaaccgctagaagcgagtcttgttactcattattacctgctcaattgataatttaaacaaataaacatgtccttaatcgcggagtatgtatcttaatcatcaatctttgatctattaggctgacaaaaagttacaggactgtctcccgtttggacgtagaaatcgacaaacttcagctgcattccacgaaccagtttgctgcttctgcaatctttaataatagagttaatgaatctgctgacgttacgcatccccttcctccttcccatgagataaatgctctacaagcagctgtgcggagtttgtcgacttgtctgccgttgcttcaacggcggaaagtattggatgtcctcaagcaagttcgcagtcaacatgagccagcaaactaggacatcctctaagggtccatactatagggatgagatgaatctcatgtggctattggctggtaaggtcgctgttcagacctttggtagtgccatgagcacactcctcgaacgatcattggccttgaatagggagatccggtattgggacgagattctggaatcctattgttatacacgctttacactgtgcaaacacttccttctagactgtgggcccagacgggtgatttttattcaactttaaagagccgttccactgaccaagccgaactgcggcttaactcgatttccgtcaagtgggagagatttttcgagttggcgcagcacagtattcgacaatgttctgaatggcacgcaaagtcctcgatattgtcaccgtttgctcgttgtaggccagaggtgcggcgaagacagcagacattgaagattctgagagatgtaaacgccagcagtatcgggattttggcggaagagtgtcttgcatttggagtaggggacgacttgaacgattctggaaagcatagtccgtcggattacgagtggcacaatatcgtgtacaagagcgttctattgatggacacgatcctgcggaatttgactgatcctaacgtcgccgtgactgaatttgaagatggtgtgttcacaactgtcgaaaacgagattcaatgcacgcaaaatcaggctgatgagaggacattcgtccaaccgatccatgttatcgaacgactcatttgcattttacaagaatgcttgcaagaaaatgcgtcgtccacgggaaccttgattcgcaaacacgggcgcccttcactccttgttcggtattggctgccgcttctacagtcctgctttctttaagtataatacttaggattctcacgagcgaaaagccgaacttctcacctggctctccgagttcggtttaagtgtggttgatttctggacaaactgggttgtgaagccgacggaaaagttaattggaacgatctgacatgatgggaagagtgaaattgcaatcatgagcagaaatagcccggtagctgatcgtgctagtctggaaaggatggtcattgactttgttctcgaccacgcagaccttaaccatgagaaggtccgcacagatgtcagcgttatctctactaatgtaagggaaggtgatttgacgcctcttttgaggtcttacgagcgagacttgcatcggcctttgattggaacattactaggggatggatcttatccgtacccttctaatccagatccagaggacgaaggttgacatagaggtagcaatcagcggcatagacgcgcgcttctcaagagccaggaacttgtttttgggtttgtgtcccctctacaaaagagggtgtttaagctgacattttattagctttgtaggtctcacaccaggaatcctagtgacttatgcgacgtttcgctggattggtagcattcttagcaatagaagggggttacaaaaagggaaggagacagatggattgagatgtgcactacggtacatatgactactatctaggtaggtatctgtatgactgatggtaactatattactggaagaaacattgatcggatcttaacatggtcttctggttccaataatatattctttcttacaatgaccatgggcttttcatttacgaggtccatacaatgagccacaaagcaaaatatactttaccgaaatcggttttccacgacatcagagaagacatagaggatctcatggatgccggccgcggtgtggataaacaactgaaggtcgtcagcaggatgcaatgggcgtactccaaatagatatgagtaactcggtcgagggcagttttattacatgaagctgtcaggttggtgccttagttcccttgaatttcgtcaagaaacgataatttgtacagtatacttcaaggtcttgcaggtatttataattcactaaaaactaagtgccccctgatgcggagctgtgtgttggtctcgctcgttcaacttcagaggagtactttgggggcgatgctgaagcttcaaccatgtgtcataatacaaccgattcaccgtaatctatgcttcggcaaggtcaatatgtgcgccttggctgaccagattgaattgaaactttgaaatctcgaaattaaacttttccctgaactttactacttgccattctagtcaattgagaccaaactctagcgccggtgattttgagggaagaataaaagggtgttcagcgtcttgtgtacccaattgctggcttaaaggataggaatgaagcacaggttatatagtaaatatgttagaaaaaagaaaagacaaaggaggaaaaagggaacattcattgtcaattgagaagtatgtgtcttggtatcctgctgtttttctcacagggcccattgtgctgttctacatacaggtatgtggagattccgctaagtagtactaggtaactacggagtagtacctaaggtaattacccagacgctaagaccccaggaaccgtatgtgaaccaaccttgtctgatttccaacttacaagcctcttgcaaacagcagatatccctctcagttactttcaaccggactgtctcaacctcctgatatcatcgccagccaagtgttgttgatgcgctgatcgtggagcttctggtggccagcacttccataatcagctgtagcgatcatcttaaggcacccggcatctcctggcatttagcccctagtggacaaaccagtgtacaaaaccatcgggaagtctgtcttcttgccaccgaatggtggcagcacctctctgcagaaggtgtgctggaggtcttatttggagactgaatactggtattgacgtgcgcttctgagtttcactataagcgcacacttataccggcgactattgcatcagagttattgatattaccatggcggggacaagaaactatgatttcttggtaagaatattcttcccaggtaacctctattacttgtgctaatatctgcaactggaacagatcaagttgttactcattggtgattctggtgtaggcaaatcatgctgcctgctccgcttcagtgaggactccttcacaccatcgttcattactaccatcgggatcgactttaaaatccgcacaattgaactggatggtaagcgtgtgaagctgcaaatatgggatactgcagggcaagagagattcagaaccatcacaactgcctattatagaggagcaatgggcatactccttgtgtatgatgtcacagacgaacgttcgtttaacagtaagtcaccaacatctatcttcataagatagtgctgatcagggtttattctcaagacatccggacctggttctcaaatgtcgagcagcacgcaagcgagggcgttcacaaaattcttatcggcaacaaatgtgactgggaagaaaagcgagcagtgtcaactgaacaaggtcagcggctcgctgatgagcttggtatcccttttctcgaagtctcagccaagaataatatcaatgtcgacaaggctttctacagtctcgcctcggaaatcaagaaggtcatggatacgtcaaaatcggaacaagctggcgctcagggagtcagtatagatcagcatggcagtggcgcgaacggcaatttcgggggcaagtgctgttgatcataggatgtatttcctgaggtgcagcagttatagccctctcagctcctattacggagtgcttcgacattcaaacgttgtaagagccccagaggagttctggaagaagctcaatctggatccctccatgtgaataataatgtggctggttatgtcccaatcttgctttagtttagtatccttgttatttgttgtctactagatgaactccttttttgtaccccttctgtcgtctctgtcaatcgcagtgttgcacaatgggaaacctacacccttgccaagtcgagtaagaaacaaagatgactgatcagctgcttcatgataagaagtgatcacgaaaagactattttgaaatcgctgtatgtttcgcaccaaagtgcagtcagcaacatgcaaaaatcaagtattctctgggtagaacgggcagcgaagatgagaataaaagcgcagtatatatgatctacaattagataaggcattcggcctttacaattatgtgcggattatagtacaggagactatcaacttttggaagacgccttctgtgccacaagcgagcgaagcgtttcgcatcagatgcggatttaaagttaattcgccaattgtccgcaactgtatttgtcgagtaatccaatggttcatcagaggtcccggaagaagactgagaaactgggtttttctctatgcgtacgatggcgccttggtttgaagataatcgccaggggtggccccgctccaggctgtccaactcgaggagctcctggatcgcgttcacactcaagatcggtctaccgggaaagtcaacccagagcctgactggaaatgactgcttgtcaatcagatctgggccgagtacattgatatggctgctaatcgcgcgcctcagtttatggtcgaacggcgacaactgagcgacgagagacaggtcttgaaagggcgaagtaatagtatactcttgtggtttaaatgctatcgactgtccctcaacggtgagaccaggtgatgggaagatgttgctggaacagggtctcggagcgtattgtgcagcgaaagccttcagtatagatgctctgtcctggtattttttagcttgtgccggtgactcgaaaaagagaatccacgaatttttccgctccaaagagtggggatgacgaagaggaaagactgtcaggattttgtaagcaatccgctacagagtgaaatccttgtgatgaatcaccttcctcaaagccctcgcctgcactttcatccatcccagagcctagtaatctccgaaaatcatatatagtcaacgaagagcttgccctggaaagaatcaaggctgttttgttatttcggtgactcttctcgtcggatgttatacgaagttttccgtatgagttgatcgaaacgcctggatcacgatttccgctcacgatttctactaaggagtcgtcgacgagtggatgaggcttcgaaaaatcttggctatcatagttctcataatggatcttcggcctgctgtcgacgatacgttttctgctggtttccaccgagtagttctttttgattgctggattaatgtgaaatacctgaaggatatgacaaaataagccaggttttggtccgccttgatatggttccttatagaatatttgccaaggccgcgaacttagcattattaagaaaatgacatctcacagtgatcatggggattacatcatttgtatagcgttgatcagactgcagtcgagaaggagaccttttcgtgaaactgaacaagatcctgctgtgttccggacttggcattaaggccctaagggtcttacggggtattcttttttggggatccaccaatcgcccatagatctactccgtagtgccactagtactaacggagacgtttacaagctttaaacccctcgctccgctcgaggggctttcaaccctccccgtccccggctacccaagcctatatatatattattattattattcttccatttttagagagcgtttttcagtcagagactatgcacgctctgcctaccacctaggcagtagggcttagtagctaatatctatatacaggtgggttatgctatagaccagtcaacagtgggaaccttctatgagggacagaaatagggaatgagagacaggctgtagtataatgtaaagaaatcaaatgttaaggagggcggatagcaataactgtgccagatagcgtacaattgatattcgcagaggtaaacctcgtcagtccatatccagaatccatgttgaaagtgtattctcttcagtctctgtcaattttcgacaattggcgattgaatctttgcgagaagtagtcccactgacacgtgttattaaggtgcttttaggcacgtcaaatgcatctgcagccttttggattgatggaaattggccctttttataggcctgaagggccaattgaagacgttcctccctagatatatcggccattaggtggtggtgggtggtggtggtagtaatagtcaaaaactcggtgttggtgttgtggctgaccagctcggtggtgtgaccagctcggtggtggattacgttatatatagtagattaggtaaaccttgctggtatgtacagtatttcccctttgcactttgcactttgcgcctgctaggctagggtttctgaattgaaataaaatatatacctggtaggattcggatcaaaaagtcgggtgtcgacagactgtcggactgatagacatgagctgtttgacacattgcaataataataaaaatagctagtctccagcgcatctgctcagtgacaagtagtcatttattgattgctttgtaggttaggtagtaagtaagtaaagagctcaacatggtcttgtcttgtctcagatgagagaaaaaaaagtaagggcttttttttagctaaatcatagtcatcggttatacataccccaatcaaattttttaattttaattaattaaagtcactataactgtatatctagtagataaatcgtagagatacgcatggtatttatcatatgttatataagacaagcatagaggcattattcgttttgttttttaagagaaaagaaatctgtacatacgtctttacagttagttatttttttttctgcgttgagcaggaaaatgaggggaaagaataagaaggagaaattagaatttctttcttttctgctcattttcgtatgaagactgttaacataaactctacatactccgtataatatgattgattgatagatagcgataactcgctgcgcacctgttacgcaagaccgcaatcgtgtttatgtattttccattgcaaaaagaaaaaaaaaagaaaccttatatttgtgtgattttgaataattttacaggattgttggaaaaattagaaaaaagcaagaaaaaaaaaggaggaaaaaaggaaaacgagagagggggaaaagagagagaggaagaggaagaggagtagcaagcaaggtatggaacgacagcaacaataacgaaataaaaacacctccccttttgggcaatcaacatcacatacttgcaataaatgagacgattcgagttgatgcagataggatgattatcgcatcttacgtctctgtttggagcactcccacagcaatccacttgatatgccagtagtatatatatactatacatgctgcttcgcactcatggccatcatcccctcagtcgacttgttgtaatcgtcataggtgacagtgacctcctgcgtctggtagatggtggtattgttggcgcggctctcgcgcaggatgctgcggccatcgctgctgttgtcattgtcgtggtcgtcgttcttgggcgtgtgcttgatgaccgtcttggacgcgcccatgggattcatgctgtagttgtacgtcgggtcctcttcgtcaccgccatccctgcccgtcagcttgacgctgcgcttggtgtatgaatagtgatatccgccgctgttgccgccatcagcccccgaactctgccccgttaggtgtttgtacaagggccgcagcgcgggaatgctgacgcagatgatggtcacggtcatttcgctgtttgtccacatgacggagccggttgttgcgtctgtcagccacaatagtcagtttattgtttattgttcaatcgagaatgacattgagatgggatgctgcctacaaaggtaatcggatgtctcgctcaggactttcaaccccgatgtccgaatgataccgcaaataccagcactagagaagacataagtatcatattagaccctggagatatcgaggttatgatatcgaacgtacaacacgcccaaactcaacgacatgcagatcgtaatccgctccttgcgcttcatgttcaggttccacagcgcgacccaggggaagaaggccaggacgaaatccagcacggcggaccacgctatctaccggtcagcgcatcgatctcggtctcattcgtgggcgaatggccactggcttaccgcacatgatggtggcgacggtggtcaagtccaggatgcagtactttttcggaacgcggggatcccagatggactcgaccggcacgcactgaatgtagaggcagatgcagaggaagatgctcagggccatcatggagatgatccagaaccagaggaacatttgatgcctgcagttcgtctgtcagtggacaggacaagagatatcaatgttagatcccaccatttcttgacgagaatccgcatcaagaacaccaccacggcgactttgctgattcccatggccagggagacgacactctgcccgatgacgaggatcttgatgccggtcgcgatctcgtcgatggtcaaatactggacgtggacgcccatgccgtacgttgcggccgcggtacacaggccggcaaacgtggtcatcaagatctatgcattctcatcagaccgcgcagaccagacacttgcgtatgtacatacccaggtgacgattataagatagtcatccgcaccgacactcgcgcggaggacggttcgagtgtacagacgcaggatgatgacggcgaggttgagaacgacctcgaaccagaggacgccaacgagcgtcgggccttctcctcggagtgccatggtcgactagacagaaggaaggtacgatatcaatctatctgcgaaggacacgcagacacttttttttttcttcttcttttgtcgaaagacagtgtttcctctccccatccggctgcgatgcgatggactagctgagatatgtgtatagatatggcaagcatagcatcacctcaaacccctgcaaccgttagggctgctgaattaggccgttggaggtgtaattagtcctgctggccttgtctcagccgtgctcattggccagggcagacgagacgactgacgaccggacaagcacttccgtaacgctgggtcggtctgctggggatatttgacaggggtctagacagtcggtctggccgttgtgctggagaccggtggatactgcctcttggtctggcaaggagtcggctctggcgcactgattcggcgttcggagggcagttgatcattgccctagttgcctatagtcctcttctattaatattggtcttatagtaacggtattattattacggagtcacgagtggcagacagattctgcagaatacttcgtccgtactatcgctaagcttgcctgcagactggtccgctgctggccatgattatcgccgccgtcacaacgactgccccggcaggattcacacgataagttatagcagtgatcgtcctccggaaggaatctgccatggctccggagtgttgggtcgaatttcactccccgcgttaaaggagagagtgtgtctgcagcatcactcaggcaggatgctcgtcaggcaagctcaggggttagccgtcaccggtatgcagcgacttcaggtaacggttttaacgcaaacaattagtctgacgacgcttcgtaagaaacaaagacaagtgtgatgttagttatagacattagtagtgatgtaacttgtaagctatacagatatctaaacaataaccccacaactaagctaacagtgtgaaggatacaaaaaacacgtctttttagcgcgtcattcggctcagagaggcctctgagcccctaaaaaccaccatggaacctcccgatccccatggtggtggtgttattcacgcgtcacccccggcaaacggccacgcggcaagccagctcacggaaatcctggaggtaccagacaccccaaccccaagccgatggaacatcactggacctctagggcttgatatgaatgagaatgatcaggaaatgacccaaaaaccgaagcagaaccctcgaaaggcactagaatcctagggaatagctggatacgaggtcaggccagcaagagccatgggattgtcaagccgcaacgacttagtaatgccatatttttgtacagcctcaagaacacgctgaaaccactctttaataagctttggatcctcacatagagcccgttgatgatcatatctgcggctatatttggatttgagctcgtggtggcgattgataaatcttcggacccaacactggccaacagtagctggtgcatttaaccggctagatagtaatagactggccatatctcgtacaatggtgattcgtggtggtagtccccgttggtccatagataatatccatttgacaagcatagattcttcagtggtagtgagctttttgctgtttggtgttgcatctacgcgtgcagtacgcccgcgtaggcggtggtagagtgttggatgtggcacattatatgcctgtgcagcagcccgtatgcttttaaattgaccatcattgaaagctttaattgcaagcaagatacggccctcttgatgaactgctgaatctgctgttttgcgtggcattttggtggttgaagttgatgagcgcgtcgcgtagtttggtggggtgtttcgctcggtgatctgtttcgctcggtgattgattacgttaactatatagacttgtttgttaccttgtataggtatggttaaaaaatcagattatctgcttctttagttccaaatttggcatagcgccatattggttgaccgttgacagggagctaccttgacgaggcttaattagtgatggtgtgatatgaccatggattggtcaggcattattctcaccattttgtctactcaagttgaacgttaaataactgggcttcaggtcgttgccaagaagtgaagacaacactttgcacaagatggctaaagatacagtacctattgtgagtttctgaaactctctgcggccgtcgcgcatgcggagggccctgggtccggagcatctataggtaggcattagcaagcctaggtatttctcccctttcaagcctagaccagagcaacgagtcgttgaaggcttgttgtatatatagtttttggctggcaaagaattcaaaggccaatcctggccagttccaacaccaaatcaagaatgccattggatgtatcgcggcaaactggactcgtaggacctcgctgcatgcttcgaacgaatgcgccgcaacaattcgccgcatccagcattccataaaagcagtcttccgccttctgccttggctgagggaggggcaagacatcaatacattggttaggcaacctcggatcaggctgactccttcctgcaagtttcagcctcatctcacgacactacccctgcatgggagccatagataaacggtggtttccgggatagcaaagcttgaggctctttttttccggttcaatccggacttctttggatggctcagcactatatggggatcgcaatctctggagctatcgccccctcctacagcgataactgcttccatgtctttgagggttcatctctacaaacaaaataattgtttctttcctgtctcccttgccgaatagctgaacatggaattcgaccatgcagacctggggcaatcagggggagaattggaaaaatgtgaaggagaagaagagagaaaggcaaaggagggagatggagaggacaaatacgacgagagggttggtaatgatgactcgggaagtcaggaagaggacaacaacaaggaaaacgacaagaaagatgacaaggaaaatgacaaggaaaatgacaaggaaaatgataagggaaacgacaagaaaaatgatgaagtggaaaacgggatggatgaagatgacaaggaagagaatgaggacaacaaggtgggaagtgagaaggaggaatatgatgaggagaaaggcgaggacgacaaccacagtgacaaggacgacgacaacaagaacgacgagggaaacaatgaggatgaatccgataaggccgaaagtgatgaagacagtgacgatgaaacagcagacgagagctccacgggtccagaccccagggatctcgcagacaccgttcttgaatccgtgaaggccatggccggcctctgcaaagtgaaagaaaagtttcaacagctccacgcagagatcagggcaaaaacaacacaggaactaaaactaggagacagcccttggggtgctgcgtttcttggaaatccagggacaggtaggaattcttgcatatccaaggtctgcacgctaatattaataccatgttctcaggcaggatgattgtcgctcggctctatgtgaaattcctcgtcgctcttcgcatcgtccagcccaggatgacagtgctcactgaattcgacaatctgcacaatcttccctgcccttccttttcaaaggaattggattgtgcagacggtcgggacacagattctgctctagaaggtgcgttcgtagtaaaagaccccgatagctggaccagcaggaacctagaatgcgttgaaagacaagccaaaaaaaaaacatggctgtatccttatctttatcggaatttacaaagacacgcaacgcttgctggactcttctcccgcattaggagacttcgccgctccgcatcgcttcattttcgacgattacggcccggacgaactccggctgattctggaacggattctccaagagaagtatcatggaaaaatgaaggtggagggaggattggacggtccatacatgaacatggtcgctcggcgggccgcaagaggaagtggccaagaaggctttctcaacgtcattgccctacggagagagatttcaaaaatcgttagtcgacaagccctacgtatcgctcgagagcaggagcagaatgggactcctccggaccccttctatttaaccaaggaagacttgttcggtcccgatccgagcgctgcagtcgaacacagagaagcatggctaaagctgcaccgtatggtcgggctcagttcggtcaaggaatcggtgagacagcttctcaaactggtgcagctcaactaccagcgagaattacggggagagccgattcgccaagttgcgctcaacagagtctttcttggatctccaggaactggtaaaacgacggttgcgcggctctacgcacggatcctggcagatcttggcttgctgagtaagggggaaggtaggacatattcatccattcacacattcattcaattgtgatcttgctgattgaaaaagttattctcagggacccgacagatttcatcggcatatatctcggacagtcggaggcgaaaacgcgcgacatcctccggtcagcagtaggcagtgtcctaggcccagcagcgagaaatgcacgatctcttccggtcgttgtgtatgacgcgctcgtgggggaacgctcgcgatgtggagaccattggagaaggcgtctaccagacagtcctgcgcgattgcaacgacccgaatagccaattgaaagcagatgcgagcgtggtgttggaatggctgcgtttgatgctgaacaaaaggaacaggaaggagattgttcttaattgagactgtgcaggataaataacagagccttgcgaatggagcatcggtctgacaattatatctacctaatatagagtcgcacagctcctacacaccgtccaaggacggtttatgcttgtgacaagccctcaccctaggccctaagccctggatctcatcatctaaccaatcccatgggctcttcgtcgaatgctgactaaaaccaatttacagcttcagcggggtatttatcaattgaccaatcagtcactttcctacccctcacagccactcgcccttatacagtacctatagtcttcatactaatcctctagagcattggtagtatctattggtgagtggcgtacattaatgaacaacgtaattcaccacttttaagggctgtgctaaattgtcgatagatccaatctcggacataaggcttgaatacggctccatgacactaatgcatacatatctcctgaggagaagcgttcgatcgacaaatatatcgaaacggaaatgacgaagatattcatgtgtgtattgtctatattgacatcacttactattgtgacactttggtgctaacggtcccaagcaccggcgtgacaggctacatcggcggcgacgcgctgtatgcactggcaacaaagcatcccgagctatcgtatacagccctcgtccgcagtactgaaaaggcagaacaagtcagggcacgctatccatccgtgcgagttgtgatcggcaatctgggcgattctgatctcttgaagaaagaagctgcagacgcggatattgtgttgcgtgagtaatccatcctctgctaatgagttatgtagcacagcactcatccatactgctgcagacacggcagatgcctctgaccatgttggagccgccgaggccattgctgcgggcctcgtagcgggacatacaaaagataaacccgggtactggctccatactggaggtaccggcatcctgacctacgaagattccgataggggagtctatggagagaaaagcgacaaagtttacaatgatctggacggtgtcgacgaactcgttaatctccctgatcatgccttccaccggaatgtcgataagattgtgctggaggcgggcacgaagcatgcagatgttgtcaagacggctcttgtttgtccgcctacaatatatggtaaacgtccgctttttttttcctctttgaatatttgaattaattagattggatactgactgtcttccttccaggcaccggtcgaggcccagtttcccagagaagtcgtcaggtctatgaattgagtagggtgaccctccaactgcagaaagcacccataatcggcgctggccagtcatactggaacaacgtccacgtccacgatctgagcgatctgttcactctcctcgcagaggctgccatcgcaggtaaaaacgacgacggcctctggggcagcaaggcgtattaccttgcagagaacggagaacattgctggggagatatcgcaaggctggttgcgcaatcggcagcgaagcagggctatataccagaagcgaaagctaaacaaatcgatatcgagacagcgaggaagctcgctgggtttgagtcgttcagctgggggttgaattcccgtggacgagcacaaagggcacggaaactcctcggttggaagccttaccgaccgagtctggaggaggagctgccgggtattgtccagagtgagtggaggcgtctgcagaagtagcttttttttttccgcagtcaattcttcaaatgttgtctctcattggatggctgtataggaagtaaggcgttgcagatataccatttctctgttccaggattctttgcgtcgatgttacacatgccccttattgtcccgaaagcgaaggcaaggtcctctagtagcttttttgtctatgaagtagaaattctcgtcgactcctggactaaattatgatggtgatggatggttagagagggagaggacagaatcattgatgtatagaccgactatacgcccaaatgatatcattccacgcccttttttgtcttggataactgttttctttggcttcacgggtgggaacactttgacgatagaatttttggtacaaataattcacttttttttttaaatactcagactccctggactcttcttgacgttagtaggtacagtacaaaacaaacaaaaaaaatatatcagcgagcatgcccccgcgttaatattttgctgtcttgaaatgtccaaggccctcacgtggctcatcagcttcttcctccgaccagttcatttgttccacagtcaatttcctcctcccaagtgggccccattggcaatttcatcgatttcttcttcctcttcctgtgtgaatgggatataaaggtagggtgtcatcgtatcgtccatatctacttcttgtgttccgactctcttgattctagacatctcgccgtttattcgaaacaagaaagaaagagagagaataggagagaaagtcggaggtggacaaattcgtactcatgtctctgcccttctaaatcactcaggctagcgatcttcgaggaagacattgattcatcgtcactgaaaccggagaaaacaagcgctgttgtcgttatatacatcaaggtaaagaaaggagccgtcattttcgtaccactggacgaaagggaaatgcatgcaagaataccatttgatgattttcttgggataatgagttcgccacaattcctgtaattccaacaaataatatcgatatccgcttctccaagttattagcccaccagtccccagcgattgatatcaattgcaatgacgagctccgcgatctgctcatccttctatccatcactctttttgcatcttcgaccgactcgaggatgctgctgcaacggcgtgatggaattggagttcgtagattcacattatctgatgggactgatcgatggatgaagcggcttgattctctagagatcaggcctgcggcccgcaactaaggcgcctgcaatgcggtgaaactaagcgagccgaaacagctgcctgggtatctggggcatccaacattatccttccgattgccactctcgcgcctgcagcgtgctccatggtgtagagatggcctgagagattgcccggtcccgttgggacggggatgccactgcacggccaacgatatgggcctccatgaagggctctcatgatctaaatggacaaggtgtcgatgcctttcatttcatggcatttgtcgtaatatacccttgcccagaccactggtagcgtcttgatctcggtctgattcctagccgttggatggttcttaatgctaacgctctcagtgagacaatcgtccacatatttgtggaagctttgcggggttggcccgatgacaatggactcctctccaggttgtgcctaccagttgggggttttcagaggcaagggggagacgatccaaggtgtattgattcaccttgtctctccactccttcacacctgctgcctggagctcccatctggcccgactaaccttcttcccgctgtgcttgctatgaccaacatacatccgcatattgaatgtgggatggtccttgtcaatgacagactcccattccttgacccagttgctctccagcttggctggaaccaggagcagattgagcccgcctttgggcttgaagttgcaggttggactccctgccgtgcaggggcagggtatcgggaattcttgttgtaatatgcccgtgcctagaccacaggtagtgtcttgatatcggtctgattccttgaagaaaacctttacccgggttttctggcgatcctgcagctgtcgaggtggtcttcaaccaacgttcggcctccgaagcgtctgctgttgttgccatttgcggattgtcgaaatctgcgcgcgtcaaggccttactggaatgattaaacaatgtgctcagaatgctcggccctaaccataccgagtaactctgagtccttgtaccggagacaatgagactgcatgtcaaagccggcattctcatgcgggagcgttggaagtgttgtgtagctgagttgattaagcgaggatagctcctgattgtcgttcttctcacggagatgaaaggcttgccagagagtcggttcacaggaacagtctggagcaacagggacagatatggtgaggaaacttaagtctttgcggccatacgggtggtctggatcctcagaccgcttgcgtttgatgcgaagatggacttccttgtaggattcttgaccatgtgaatggtgtcatggaggattgcagactgttcccttttcggcaacatcaagggagacgagggttacttgtgttttcaacatatttaggcgaaaaaaaaaagcacatagtcgacttgattctatcgactctgtctctggtcagtctgcggagagactggctggctcacaaacaggcatttttctgatcagcagccctaggatatgtatgggcgatggggaaggcctgacgaatgatcgcgtcagacagttcactgacaccgcgaagggtagatgtgaggactcatgggtcacccacttcggtaggctcatatgcgcggaaggaaccgcgttcgcttgtgtcgtttcttcgcagaatcgcctggagaacagcgacggtcattccattctcgagccgatggttcgctcccccgctggacgcaatggcaactaaagttggcataaaggcaacacggtgggcatgtccggagtgcgcctgttggacgcacggccgcatgaggcggatcgttcccacgggctgaatcggtgcggggaccagtgcaatcgggatctcgggctgagaccaactaagactggtcttctcgaagagaatgagaatgcggatgttcgaggcgggcttgcaggaacttcggatagtgggggacggtccttaatgtgtcgagaagattaatccctcgccaacatgggcgttgtactccaactccgagagcacatggttgaagagcgtcttttctctgatttgtccacactccacgattaaagcgagatgttccccagtgtcgactaaacaggtacttggatccaaggtgcttcctggcattctgtcggcgaatgacctttctctcgatctctgaaccgctccagtccaagcagtacgtaaaggtcttcgggttgttctgacttatccgttggatccggccatatgcttggttctcgatgttaggaatactctgtggttccatcacaaccatgcggaaggcacgagtgcaagtgacaccgtcccacaaaggtcaatagtgctgataaggatctggggacttataacaccgtcgtaatcaaccccgggatccgcactctgcaaagccgaaataacaccggaaggatttttggtggtagccgagatagtgctcctcacaatgtgaggatagcaccgtttgaggtgctggaagggttagcatctctgtgggatcttgcgaggggaggtgtacaagggcaacaagaaatacctcggtcaacatctccgccacagcaggaaagaacgtcaggatgaggagcttttcaagccgacccaagtgatccttgcccaactggtcgttttgatgtcacagatgcagagacttggttggattggtatgctatatgagcgaaggacaacgcgtgctagtgatctagggctggactgaatggaggtagaaacatcggcgtctcgattgatgctgctggaaatggatctcgaagtatttcagacaggacgtcggcatttcgacatttctgcctccttctcatttgtatggatgccgtctttggactatgatccctcgtttgacccgtcattcataatagtatgcgaaagcaatgatgtggaagtcgacttcgaggaccaccggttaccccaactactgcccatacagtttgatttcgagcgaccaaactcagacggcaagttattcacattcgtaaacggacagaaaacttttatgatgttagttttctgagacccatttcgaaagcttaaactagacttaccacatcaagctttgtttgcaggattctctccgtcatgatgaatgacttgtttcacatcatactgtatccgtctccatcttgccaagccttgagtgattcctccagaaactgcctgaacttgtgataagtcgtaaacttgtatcggaatcctgaataaagtgctgggaagagggatgataggaatgccacgtcgaggaaaacggaagtaaaagggttattcttggctgattccggctaaaattagcaacccttctggtggcttcaggtccttggcttcgccattgtgattcaagcactctttcttttgcgcatttagcggaggactcgtaggttctgtcctccactagagtgagcattcacggacgtaatcggcgcccaggtcgaaagattcacactgatccgcaagtgagcggcgcggtaaggagttggttctcagtagcgtggctgccatagcttgctacatcttccgggtcccttctggtgcagctatcggtggtttgttaatacctgcagatcacccatgtcatggaggttagcctgttttccttcaacagggtgatattctccagatcgctttcccagtgttccgttccagggagcatattctttagcaacaaatgcaaatgttagcatatgtattcatattttccatctgatagcgactcacctatttatattgattggagagccgcgcagcagcccaatcatcagtgagtgaaagggctgaaaattgttctaatgcatcttctcttagatcaacttggactggatcgtcatgtttgttgctcttgagcgagctgtcgttcatccaatgttaatccttcttccagccaacaagtctgtgttgacgggcctgcaaactgcgccgtcataaaatcgctttgctgtccgcctgggttgcctctaccgggcctcagtggcagtgtcctcaatatcagggaacgcagtccttatgaatgagccaggggccatgcaacctcagtgccaacacccgtacctgccagatcacctggcacggaagtcattctcgcccgcaaaatgtttccacagagagttaggtcatcgccaataaaggtccagaccggcgaccatcatgtcgtcgcctaatcttttccttccatattaccctcgtctggtcagagacaccgatccatgttggtggtctatgcgagttcacagcagacgaacaaatcaagtctcgattccattccaaagacccagtccagacggcgatattgacatagctcatatgaccactctgccttcatcatggatagcttctggacctgtttgtgtgcttcgtgcggttctttctcagccttgataatgaatcgtcttggacttcgactaaccctaacactcagaggtcgcgggaccagttccggtcggggacatgtagcaactttgccaaatcctcatggctgacgtgctcagcggcgcagtgcgactctaaggcagacgagccgttgcgtttcttgctggcggtatgttgaacacactcacttgttcgaaacgtcctcagcaactgctggtcatttcacttgtccatcatcgcagtgagtcctgcttcgagcccaatcttctacactctggataaccggttttgcagattcggaaagtaagccaacagcgagtcaatctcttccgtgtatccagccagcatcaccacccgctttgcagacacgaaagtcggctgtgactgacgcggctgaaagaatcgctgtgcggggatgcaatgccgtaactttttcaggtatctgggagaatctcctccaggaccaggaggtggtttgggtcgtttaaatttctcggcaacattgatgcgctcagacatggacattcctgcccggagggtgaagacgtgaaaccccagcaacttcagaaacgcctcaaggtggaactggatcatcggaaagtgtgcaaacatcatcagcttgcgccgatcctcgatgatgaccttctgcacaatacggataaggggtattgcagttctctcgttgatcaagttctcggccattatatcatggcactcaatattgattgcgaacaatatcgccgtatatctatctcacgacctcttttgtcatttcactgctgatgatgacaacttcatttggcagaaaatagcctccgatgcccctccagcgcagtcgcaacatctagggcacgtttgctgtcgcctctgggatgtaaacagccaatcgtaatgataacctccaatgctgaaccatcttggaagctaaacagatgtcgatgcttcattccccggcaggaggactgatttcacgctcggtattccgtatcattctcatggaagacttaagcgtccttgaggacattggcggcctgtgttttcttgggccagtttcgcccataaaagcgcgtaataaagttctaattcagttggtcctccagagaattcgaacatcgcgtggagaggggactataggccgcagctgcattggtccccgccagaagccagaactggggatgatagcgtgatagttgcgagaatgcagaattgactgcctccgtcagcttggccgagcgtctcatggtattcatgttctccgatgctgccaactcctaacatggtgatatacgcgtcacgtctcgagaaggacatcttgactgaaaccagtggacacggtgggacactgcacgtgcatagtccccaacctgaatgaagaccttcttgcatgattcgggtagtatgccgcgaacgtttcgccgtcctccttcttgcaaaacttagcgacctctttagctgcctgcctgaccatcaggccacggacgaagaatttgagagtaggatccatgagtagcaaggcttggagccaattgactgttgctgtctgatagctgaacgtcctcgaattgaatagattgcatgcatggggtgctatatcgccctggttaccaccagctgccagtacagctcgtcagcgatatgttcgttcaacttcggatccagattgcctaggaaggctggacatagatatgttttccatcaggctggacccctcttcatcaactggagatggcgattgcaatccagtcaagcttgcctgtgataggaagaaacatgctgttgccttgcagactggtgcctgtgggtcatctgtcacccgatcccgaatcaagaaccgcattgctatgtaggagaggtgctgcgggatggcatagaagatcatgtcaggcgcatcttgattcccgggttgctaagtaacgtcccatcttctctagacgaaggatatccgcccttgtcaataagggcggtgacacaccagagagaattccactgacggagatccctatgggagtagtacactctaatcgacgaaccggacctgatacagaactctctcagattgagcaccttctgcagtcacatctgccctgtccaaggcccgccacttcgttgaacaggctgatagtcggtgcagactgcatattgccacgatgagcttgccgaatactgataggctgcttgtgtagaggccgtaaaggatgcagaacttgcgcgtgaccttgtcgaaacccttgatgaaattttcgcaacgtatgggtgggaggagtggacgccaaactgctgaaaggcctcgacagtgcgctggatcagcgtcaacgccagagagctggtgtctcgtcgcttgtgtcctgagacgtccacacctcgtgttgtaagatctgcctcgtcaggcagtgctgcttctcatctagctgcggtggtcacaaggtcggttgtaggtgcctgttcccatttcatctcgtggaattcgtcctgaaggcaagggaagaaaaaggaaccgtcgtcttcgagacctcttccagctccacccagtacaaggttgggtcaagttggccagtgaaggcctgacaaatgggcatcagacaggtcaaagaggtcgacgatgaacaaactgattttactgcctgagacacgtcctgacgcgtattagaatgatattcaaagagacaggcaaagaacaggaagcgagaacaggcaagaggagtcagacacgtacagagaaatgatgtgcaagccggactggttcgaagagatctccagctggttatggtgctggtggaatgtacatttctcttgggatgacatgccatgccatgggtgttatggacttgtcatgaccaatccgaccaagacccagtctaacacgcgctgcttgtgtgaatcatctggatcgggacaacgcctggatgactcggcattcttctgcattgctgtctgaattgtatatgcagtcaatgacaagaatagggccacatttctcagtgttcggtgcctgccgcggtaacaggtacagaaagagaacaggtttccttgcagtcgtgcagtagctcataatgtaagagcggtgatttcttgagcgtttagcttttcatagctcgatttgctccaacaagtccgaggaacaggggttgtcgatggctctgtacggctcaattgatcctttaacaagcggctcgctggcaaattcgtcaaatgcgcagccaacagaaccagtcgttttctgctgctgctgcgccatcgccgcagtcatagcagcgggaagataaatatcccaacggccggtttgcccatattgttcaaaaggagtgttgacggaactgtatacaacgaatgataaacccttgtcatcagacgtgatcatgtctccactcagctgcatcaacagcaacagatatcctagaaagaggaaatctgttgatgcagctggactgtgtgggaacgatgggatagatcgagcaatcgatgcgtaagcagctcgcggtcagctcaaatatgaccagctcgatcaccagcgagatgagccaacatgcatcacaacgcttggacccattcctgaatcgaaaggttgttagcatcgctcatcgagacagactagcatgggaattgcgtacgattgtctcgacatcaacgtcatttgatgtgctttcgaagaggacctggtattgttgacttggctgagtccggatgcatgatgcattcataactcggtctccagctagcatctctgaacagcacaattgcaatccacgggatagttccattgattagccacgttcatccggaatagtcactggaatggagacatttgttgtgccctctttgaattgcactcaagctgctcgatcgttagcaacttcgacttcgacttcgcgacttgacttgaaattctccaaggctgctgcttcatagtcaggtatgtatgcctgtaccgcatcaaactcctctcaagcctcgtcagcttcaatgcctgccccagtatgagatgactttcctcactacgccacattccaaatcaatcacttacttcactgactcgacctggatggagaggagaaggtggacgatttttccacaatgaccgttgttactttcaggtcgagagtccgtctcttccaagtgtcgtataacgataagacagatgcgcatgcagttccttggtggagacgatgtattgcttgattgccgggtcggagacaccacctgctagcgccctttgagctgtagtacatagaacaagagcttcagatagtcgctaaagttccggcgcacctcctgcacccacccactcacgatatgggagggcgccaggacgagtgtcggccggtatgtactgcgcatctgttcggaatccttctctttcgttggcaacaatttattcgtagcacgcgatttgccagtcgctgtcgtcgaacatatgtatataccccttctgtcttttgttcatcgtcacagaacaccttcgtccgattttcgttcagttctcaacggcgtccgaacacgacagccgccgggtacgactcgtgacaacgggtatcaactgcgccgacatccggcacttgggtcgagttctccatgtacatacgtgctggaattggtgtacctggctgagcagtgggcatggagcagagacagacaccgtaccagcagcacctgagaggaagtgtcgatgctgggtttatatccgtagcttgggaagacgcaatcagtgtcagtcagaagtccactcgctagtttcgacggcgaaccgtgggcagcatgttcttcaccttctggttcgctcggcatggcgttatataggagcagcactttggtcaccacctagccttcccagtctccccctgttgacggttggcttgcttcttggctggctgcgcaggaccttctccggcaggctgggttatatagtttcgacatcggcttggcctttcgggagtcaagacattgaaggacttgcgatctttggagattgggacgtgacttggtatgctgtctccttcggtcagcacgtctttggccgcgcggcccttggctggtcctcgactagacgacgactgttctgccaggatcgactgaagtatctctgcagaaacgatgtaccgtcgcgttcgcggatctgacacattcccccagccccaaggctactgtagaaaaaaaaaagagttgcagacgatcagaatagtgtcgtggcgatggatctctcaatccagcagttgacctgaccaagtgcgaagtcgccaaaataagggtccagcacgagctgtaaacacgtaatagttttgccaagtccacattcatcagcgagaatccctcctgcaagcgcgctctgctcctgcttctgcatccatgcaaccctggtgacttgccagggctgcagttgcaaggtcccgactgtcgtggagatgcgcagcgtattgttcatagacttccgtgagacggcgatgtcgtggcatagcctctcatctccagatttcaactgtgaaaattcacctcgactcgaccaggttaagtgtacccgtaccaggatctcgtactcgggctgtccgtattcgacttagagatctccttctcagcccagatcaggggcttcttctgtcgcttcgcgcacatggggtgttgaaaaggtatgtgaagtacatgtatgtactttactgttctcgaaagagtcagcgttgctgtcacataaaatcctgattgtattccattccagcaggggaagctcacctcgtcaatcagttcgatagaaaaaaaatattgcgaacatagacaggtataggttggaaggtcagagatgatggctttcccccacccacacacccacccacctacccatctgaggcgtgatatcgtcagggaaataaacaaataaataaacaaggacgaaggaagtcatgaagatccaaaacaatcaatcagcccttgtcgtttctgctaggcagttgtagaggaaagaaaaggaagcagaatcgccctctccttccctcttgaaatgacagctcttatataaagtaactccctcccagacagaaagaagaacgttccatgtccatcagatttgcacaactctggtttttttgactcagacagacccagacaaaacctctgagtactgaaagtttcatgtttcaggtttgtttctttctgtagaagttgcgatgctctgacgctctccattgttgttgtcttctcggagaagagcacatcaagtcaatcaactcaggctaaacaaaacagagacagagaggcgaagagaagaaagatgatgaaggcagagagctctgagatatgtattctacagtactgtatataagacaagacaagacaagatattatgaagtacgcatgtatataaaaatcacatatcacgtgtcaaatatcaagtatataagtgatacaaagagagagaaggaacagaaagagagaaaatacgaaggaaggaagaagatgaaggacgaacttatcttatccttttacactaccactgccaccgtcactgccggaacctgtcagaagttagaaccgaaaaaaaaaattaagaaaagcaaacagcacaactcatgcagaatcagagaaaatggagcggaaccggacagaacggaagaggatggatgcaagcagccgcgacaggaatcagagcgggtacgcactgtaggttaggtacctacctaggaaaggagggagtatatgtccatgcatggggaatctatttcctgtttgcaactgagataatatacgagctctgtgcatggtactagtcatagtttcttcttgcacataagaagtagtaagtaagcaagcaagcaagcaagtaagtaagtaaatagctataaaaagcagtttcaaagctgagcagtttcagctgacagatatctctaacgtcaaccagtgccagatctaagacactactacctacaaaacgaaatgaaacaaggcagccatccctgaaataagacatggaaataagacatgatcaagcaagcagattctccatcaaacctgcataataattttttttaaaaaaaggtactattaactaaaaatgagagagatacctgtgtatactgtacagtacagtaattcggcatggttatgctttcatgcagtgtgccgcctggtcaaccgtcagttagtgtcttatgattcatacatacatacatacatatcataactgaagaaccagagtgattaattaattgattgattgactggataggctatatgcacaatgagaaaaagcaaagagcttgtaagtaaccattacgagacttcagaacagtgggcttagaagtatgacaacggccatcctctacactaacatctacctacctatctactatctatctcaccaaaacacactggatcgtttttttttttggacaaacatttaaatcgccattgattgcattttcattctatgaagtgcgggcccgccccttgacttgacttgacctctggtctcatctcgtctggccattcattgcctctaactaagcatgtagagcacatagtatcaatcaatcaatcatagtatcaatcgtagtatctaaaatggccggcctgtaagaagagagagagagagaaagtgagagagaagcaattaaaatagaaacatgcaagggaacaacaacaacaaagtgacgcgatgcgatgcgatgcgacgcgacgcctttaaatgattcaattcattcccggcccagttgatgacttttctttttaagagagaaaaagaggatgcttttgtgagacatgcaaaataagtgagtaaaaaggcacaagggaaagggggaaaaaagaacagcgccacctgcaaaatgtgtattgtatgtatcacgtatcatagaaaagaaacttctttttttttattcagatcaaccagtaaaggggttttcctcagtcatgaaaaggtcatgcccaacggcttgcttcccgctcctcctcgatccgatctagttcatcatcctcgtcttcgaacttgtagctcaggcgccgccctcctgccagactgcgttcgtgccggctctcgcgacgccggctgactttgctctcccgctcggcgttcatagcctcgcgccgctgctgttccttgagcaaccgctctcggttccgggcttcgcgttccagggtgtgcggatctttttcctgttcggtggccctcgcgggcttcacgtctgctgcactccggtctttatcagccgcatgccgccggtctttctcgccgctccgcgattcctctcggtggcttcgcttggcccggcgcgaatggtgccgggatgagtcactctcggcaggagactcggagcggtcgcgacgtgatcgtttgcgctccctgtcgcgttctcgttcccgctctcgttcacgagctcgttctcgctctcgctctcgctcacgttcgcgctcgcgctcgcgatcccggtctcgttcgcgatctcggtcccgacgcctctcacgttcgcgctcgcgttcgcggtcacgacgcctctcctcttcgcgacggctcctgctaattcgactcgcaagatcgcctttatccactgcgtaatcctcaggggtagccgactctcgatcgcggtagcgagactctccgttccggcttacgctacgactgcggtggcggcgtgagcggtgcgaacgatgcgaactcttgcgatcccggtcccggtcccggtctcgtcggtgcgaggagcgtcgtggagattcatcccgggatggggagcgcgaacggtcgtcgtctcccttggacaacccgtcttcttcctcctctcgacgagccttccgtctgtggcgctctcgcctcctgtccctgtcatcttcgctgtcgtaaggagtctcggatcgatcccgatggtgacggtgatagcgggacggggattctgatcgtgaacgagctcgagattgggatcgcgatcgcgacctcgacctcgaccgtgcccgagagtgcgacggagatggagatttcggacgagtgtcctcttgacgggcatttccgggagttgcgctacaaaaaaaaacgttagatatcggacaacattggccatggagaatgtgcgtaccttctggagacttcggccgatctctgcggcggcatcgaccctcgtccctggaacggaaagccgcgtcctcgcatgctggtgttgggcagtccttcacgcatggcacgaggtgcttgtggcgcgccttcgacgccttgccccatgcctggcatcggctgaaagctcccattcggatagccgccacgtccaccgtagaagcctcctcgcatgggtggccgcccgcgtccatagcccgcttccatcatatgcgttgggccagtagggattgcctgagggcgagaaaaagcctggtcgatactttcgatagtcggaataccctggagctgctgctccgattgcggcgctgctgaggcctccttttcgcccgccgtctcctctggtttaccgtccggcgcagcagcattatcggcgtctttagtctcagaagcagaaacaccagctccgttggtgttgtcctctttaggttggccctcggcgagatcatcttcacctccaggagccagttcttcgttaaacttcttaacatccgcctcagacggcgcaccctgctggggcgcaggggcgtcggactcctgagcctgcggaggtatttgatttgagaacgctgcttggttagtattgtttcctgggtagttctgattagcattcatcggtcctaagaagccgccacgacctcggccgccttggtagtagaagccacggccgcggccgcgacccatcatccctcgcccgtagccaggaccatggccatagtacccgttctggaaatcttggttagggaattgcgatggttgctgcatctgagaatagttcccgttggagtgggacatattataaccgccagcaaatcctgaggcgccataatcagggcccataccattcgcgaatgcagttggattgtatttatcttggcctccattccacatattgttctgtgagttgtcccatcctccatacatcccttgtcctgcatcaaaattcatccccatgttcatgccattgctcatatcattcatgttcatcccaaaacctccaaacatcccctgagccgctgccatcgggtccatacccatcccaggcattcctgcaaggacagacatgtcagccgccgtagtttatgggatgcatcgtcattaaggtgacacctacccataggattctggaagttcgccatcgcattaggcatgaactgccccatggaattaaagtcctgaggtccgccccaccccatgttcggcatcattcccggagccatcccaaatcccatggggttcgggaacatctgtgtaggtccattgaactgtcccattccttgctggccagactgggtaccgtcttcgcccgaagcatccgcactgccttcagcggtgccgttcggtccggcgccctcgggtccttcattttcgccggcgacaccgtcggcaggttcctggcccttctcgacgaggttagtgctggatcttggtactcagacaatgagggccgcacttacctcatgaggcgcttgaggctcgccatctacctcacctgcattctccgccgggccctcgactggcgtggcgtcaacggaaggttcttcagtcttcccgtctccgcttggagcagctgctgacggctcaggaccaccagaatcctgaccagcagagacagtagtggtctgagcccctgtctgatttgcggcgccgtcgacaggtgtcgcgacggtcggtgtcgtggagggtcggtccttttcccgcttcttctcctccgtccgcagaaaagctttcagggtggtgcgaagcgccttgttaggtttacagaggtcggacgagatgggatgatgatcgcagacggggcaactctccggcaaagactgctggcctggacagcgatcagtatcttgggccacccactcgaaacccccagaatgtagcagtgggttaaacttacaattttcgcatattgcttggtcgcaacatggcagtcgaaacgcgttgatggccagcttattgcagatagcgcatcgcaacttgaaaggaatttcatcctgagtgagagagctggaggacgtcgcgttagcaagtaaacccggtccacaagtagtcgttcattcagagagcgctcctctcaccttgcgatatccatcaagcccgcggacgggtctgtcgacgccatcgctgacgaggttgcagttgtcggagcttccccagtggacgtggctgaggcgaccgttctcacgcagaggtagaggcaaagtcaacgacaaagagcgcagacatgacgacaatgccaacggcccgaatgcgcagacactgttttttctgcctacacaaagggctgttggggaatggcaacgggggagcgcctttgatcaatatggtctcaataaaactgccggatggatcgagactgcggattcttccccggtgtgcccggcccggaacaacgtttccccatctggtttcccgaaccagttagtgactgcaatgctgcgactgtacggcggtacatacaggtaaaagagcacatcaatcaacgcagattgactttattctcgaattttaggccttttccttcttcttcttcttcttcttctttttttaggtgctacatctatttttgaatgtgatgttatcctgctgcgatggtggtttggtccttatacaaacgccacttttatatttttctgtccttttaactatgctctaatgtttccattaggattcctacatttaattatcgcacaacaatatcgtcaacgaacacgcaagcgatactgtccgacagaagacctctcctactctaattgaaagtaatggctcaagggaggagattgggatggtgggttttgtgcggacaggggcgaatatactccgtataggccactgaaccgaacgaagcatctagggcaacacctcagattagatcaagtaattcttcaactctcattgatgcgggttgataatctggacagttggagacgggccagcgataccgcagaggcagcctcccggtttcagcccagcacgcgtctgtccacccggcatctggagtcactgctccggtcatcactggagcgccctagatagataattcgatgacgttgcaacggcaggatatgaccaggatcagttgagagtctggaataaagcatcagaaagaagaaatgagaagaaatgtcatggtatcggagacggtcgccaccgagagagcaacatcaagctctctcttgttgaaagaaaagtcgaaaatcaatcaatagaccctggcgacgacagtccaatgcgcctacgtagtagacagacagctaaggtcgaattatcttcctcttcaagttagttagtaccgccgtaaactgtatttcatcaaacttcatcaactgttgaatggtccgttgtgtgactgttttggtggactgagctctggcttcagatggtactctggctctaagctctctgggcacgttggtattaactagcttgctctttcaccaggggatcaagttcactcatgcagttatcttcggatcagtgaatcgccgagaaagcgatcggcggcgatctcgatggcaatgctacgcacgtgacttggggtggcacgggagccaatcaaaaattcaggatcggagagtccgcgaagagaatgtcccggtcggtgagcggaccatggccgtggaggggcagcatgacgatcaagggtcgcgatgaggacgacggtggtgagagctgtcactgtcagtgcaggaggaaaagcagtatcaggcggtgagatcagaaggtgaagaggccagggcggagctaccttaggtatacgatatcccgcagatcgaggggccgaggaacggtgacttgatgcagaatctgataggtggtggcagtgaagggaggcgctgactggcgcgcacgacccagggaatcgtgcgtgctcgcagggcggcgacagaagcagcgcagggttaaaagggccgcgacgtcccgcgcccagcagctcctcgacgaagccccctcgtacttccacgcacgcccgtctccagccacgcttccgttcgcgacaagtgcccccactgggacgccctctcagcccctgtctgctgtctccacgcaccgcgcacgcaccgctgggccagtcccctctgcgcgcttggcttatcgcgataaaaaaataaaaataatagcagtgccgcgacttccggaaaatacgaaagacggacccccacgacctgctgcttttctctgcgcagcagaagaacagtagcaggcagatcctctgactattacaggtgactcagctgttacaacttgcagtggtgtgcgtgttgggcttggatgcagtagcaacacgcaccatccagagcatccagattagtggccggacagcagcggtaagttaccacactgcttgcttgacttcgtctgtttcgcgcctgtgggtcaacagggaaccacagaaaaataaaaaggacgctcgtagctgacagccatctactggtcccagcaatgacagatccagacagctcctaccgccctcgttcccccgatttctcctccttccagcctgcctactccgcccccgtcaacaccgcctaccaaccgcccgcgccatatcccctggccagtccgatcgcccagcgcgcttcctacgacgcttctccgttcttctccccacagtaccagcagcggcctcccgtcgtcaacagccgcattccgcagcagtacgtgccgccgtctgctccctacgacgccaactccgacatgtctcgtcgcaccacccggtcatctaccgccgcccaacagcaggcccaacagggacaacaggccgtcttcgagactcgcatcccacctgcccctccggcgcagccagtggagccgccgaagcccaagccctgggatggaatcgaagtcaagaccaagtttccggtggcgcgcatcaagcggatcatgcaggccgatgaagacgtgggcaaggtggcacaggtcactcccgtcgcagtgtgtacgtatctgtctggattttcccttttctcgagttctgttgactgacaatcggtccagcgaaagcactggagttgttcatgatctcgttagtcaccaaggctgcgaaagaggccaaggatcgcaattccagacggataacagcccttcacctgaagcaggccgtcgccaaggacgaggtcctggacttcctggccgacatcatcgccaaggtgccggaccagccgggcaagaagggcgacgatgacggcagcgatcacaacgaggggaagaggagatcgggcggaggacggaggaaaaaggagatcgatagcgacgacttctagcctcggacaatcagtcctccacttcggtctctatataatcttccttttcccgcttgtatcggatctcgtgcagctggattccgggatcttttaagggtgatgatagatatcggatgggttgcataggcgcgtgggttctctgtgatgtttttcctaatggcgtttgctttctggttgcgagtagtctgggactgggcttcctgcatcgtgtgcatgtggatatcctccctccacatttttgtttttctttcttgcatgtttgtcttaagattctggagttgcaatgtctggtttgcgccatgtcctgcaaaccggacaaatgaagacgaatgggctggacctggtcgtcattgcaatggttatgcttcatgccatccttctctcttcgtaatgatccatccaatgtaggccaagttgtctgtgtacatactagtaactacctacctaacgtatgcgtactccgtacatagctaggtcggtatatggctgccagacacgtgacggtacctcgtgcttcccgtgactgcaactcagccttttccgctttggggccagctgtctcgcggtggagtcggagcgcgtctcttccgtccagcgatcaacggagttgcttgacctgcctttcccccgcggtggttgctggctccgagaaatatgctgccggcgccgaaccatggactttgtatgaccccagaaatgcaaatcgcaggctgccagttttgagaaaatggtggacgaatgctgattgtcttccccagtggtcacgtctcattggcggttcccgctcgctatcctcccgatccccccgaacgacctccccggctgaacgactggcggcgttcaagcggacatgcaatacactgcaagtaagtttggagcttcatttctattcctgcctgtcctactgtctgacagggagcctggcagcaaatctggcggacgagtaatgctcccaccgagctggccgctaccattcatgcccgcaattgcatcgaccgcctcaatgctgtcctcagcgacgaatcgcggggtcccgcgcctcatccttgtctcgcctatgcctccacatcgcagatctatgtgacggtcacgaagctggctctgacctaccgggatgaggacttgattgcctccgcctccgtcttctttaacaccctgatcgacgctgaggtggacggcatcgtcgacagccgggtcttttcgagagctctgatagatctcgtccggagatcgggatcggccattgaggatgtcgaagggagactggtagagctgttgtttggcgttgcgaacaacatccgtctgcagcccaggatcttgcccgcctggttcgcacccaagcagtcatcgaaccgggagcagcaccccattacggcggaaaaaggatttgctggggcaaccaggaaggatgactttcctctcttttatctgcttgtcgactatgtccatcgcgagggccgggccggcgactttgcccggacgggtctgctctacttgatcgagacggcaacacggtctaaagacttggagaaatggcttatagaaagtgacttggccacgcttatggcaacgggtttaggtgctctatacagtcaactaagcaggtgggtaaagtgataactccctgttgccgttccgagctgacgtcgtctctaggcacttatcttcggcattaacagaggataacatgcctacgatcatcgccctgtctgacgaaagtagttcccgggctgcggtcaagccctacatggggtcagacatggatgcgttcctttcctatctgctgttctggcaggataccatcgaccattgtcggtccgccgaagtcaacgataccttgttggaccactttcaagtgctatttttggagcagcttctgttcgtcactactggtttaactttgatggcttcaaggccgtactgactctgccacagctacccctctctcctcgaatcatccgacgtcgaaggcggctcaacgtcggcagtcctgacgtatcttcaccgaatgttggaagtgatcgaccagccggaactgattcatcgcatcctccattatctgctcgcctctccatccgattcacaaccgactgtcgatgcggcaccatctcagaaggatatgtcagttagccggagaaagtccttggacctgctcgcagcgtttgcggaggaggctgctaaaccgtccccgtctctctttaacctggtagacttgattttaatgagcatcaaatcgcagaaccgagagaccgttgtcgctacgctgaggctgttgacggtgatcttgcgcaggcaccattccttcgcaggatcgttgatcaagacgtgtcctccggtccgggatacccggcggacggtgggcgcgttgaacgcggaattgcgacaattgctgtcactggccacctcgattgttgacgacccttccatagacgcatcgtacgacaattacctgagagatgccgcgctgattgtcgagtctcgcctatttattgctccctcgccgggtaccagcgttgcggacggaccggctgaccgaccgctggatgtcagaacggacgatctcatcttcaaggagctgctgagcttgttggaaaactttttcaccaacagtgttgtggtaaacctggcgttgacggaagtgatcaccagccttgcctcttccaacttggtgtctcttgatggctggctgcttgtcgagccgtccaactacgaatacaaggcggatgcaacgccgcggtcgcgggttgtgttctccgagccggatggcaagacaaagacgcccgagtcaggcattgaagatcttatagcagttgtcaagcaagcgcacgcagagcccacttggtcgagcgagaacacacctccgattccgaaagtcctgcggcggctggtcggatatatcgcacaatggcgacgtgatatgcccgattttgacgttctcgtggctgcacggcgggagcttcttcacagtgatgaccaagcaggcaccgaccgatcggccaatgcgtctcgacagccgtccgagcctccgacgacgcgcacgtctatggaacgtcctttgcagcgtaacgcacgggctgagtatgagtccggttcaccgcggggacggagtacacggcctttggatgagggtccatcttcgatgtctccgcgcagcgtcgggtcacctttgcgcgaggccgcaaccgactcgcgaacgccgtccaagccgcggcccgttatcgctgaagatctgcgtcgacggctggcgacgcagttctggattgacagcacgggtcggttggtgtctgaggagggagctaaggtggttgacggcgagcctgctggggatgcatctccagaagcggctaggaaggtgacgcttgggcacattctcactaacgccgtgatcctgcaagagtttatcttggagctcactgcactggtgcaggtgagggcgacattgttcgaggaggcgggctacctgatgaatccgacagtagacaacttacagctgcaagaactctagattgtccctttgcatggttgtgtccgttatatacccttgtgttagctatcttattgacgtttgtattcagcgtaactctagacttgtctatgtctatcaggtttaggaaatccaaacgcactcacaatacctgagcttcttatttagtgcatacaactttggtcaagtaaagccatcaagccaagaagaatcaaggatattaatttattatcaaaaaaagcatactgtcaaaccatcaaatatcatatgagatttgctattatctctggcctaggttcgatttattattctgcatgcatgtacgaaggcaaacaatcgccatacgcagagaaaaaaaagatcaaaaaaagcaatcaaaaaaaagcattaaaagaaaaagggcagaaagagaagtgcaactcaatactaaagttcatgaataatcccttttgaactattctcctgaaggtcccctgtctatatcgcctatagttttcctaatattcgtaggagtcacgctatataccttagtttataaatccttatcttaggtatctactttgatatcttgcaggaccgtaacccatacgaattgatgatgagcgagtactgattcgtaatctcctgagacctcctaggagtgcagaagaagagtcacatttgattttatgatccttgacaggctcgaccaaacgaacctgcagcagatataaataaataaataaaactcatccattattcggtctataccaccaactgggtatttgtttatttatttatcaaactacttctactcgatactagaatagtatagttcttcttgatgcacagaacaggatgaatggcctaggctaggcatgttctttgcatgtcaggaatctcgcatatagcatacatactgatactggcgagaagaaaaaaaaagacagagtatgatgttgaagatgaccattgcagagacaatatttagttgtaagggtacaaggcttgtaaaaccctctctctgttccattctgcagatacaccaataatgaaccactccacggcgtataacaccacatgataaacaacaacatcgcctactcctgcaggtgaagaacaaggacagtgtcttgtccagacagacaagaggaagacgagcagagctgtccagcaagaaatacgttaatatatacaatatggcctcttaactggaaatgggtaaaagacacatacatacataacataatagctaagtaacgcagatatataaatagcagaatccacaccacactactagagatattgattataaatgcattgtatttaccttattaggtattaggttattagttctatatatgttagtctagcagctttagaccattaataaagaagattatttccttttttttttcttgtatttttcgttttaaaaaaaaatactattacaatacaataagatttctaatatccctacttaagagacgcatattaaattaatagcgaagattagtaaactagatgtatctttatttagtatcatctacctaatctatctatcacactaggatacggcgtatacaataagtaggatgtatgcctacacaaacacaaatcgcacatggacatggacatggcgtggaaagaaatccgtctattcttactccgtaataattcttctggtccagaacaccgtggactggttgcgctgggttggcgtttcgcggcttaagctgttgaaacggctggcgtcaacggcgccgaggctgacgtgcttgtcttgcagtatccattatttgttcggaagggcgctcgatacgatacggcatctggtttccgatggatctaataattagttagttagattagattatattataggtattattaccttccgcgtttattgttttgactatatatagatactgtagctgaacatcacatctgaatccgtcaaacaagtcaactaacatcaattacccatccacacagataaagaaatacttcaaacatgcccaccaaagacagcaataaccccctacgagtcctcatcgccggggccggcatcgccggactcgcaacagccatcgccctgagaaggatctccaacatcaacgtcgacgtacaactgtacgagcgagcgagggagttgaaggagataggggctagtatagcgctgagtccgaatgtaaaaaccagttttctactctaatctattctcttctatttttttgttttttttttgtgctgactgcctgcctcagggtctacgaacactcgaaaagctaagcgtgcacaacgctctagacgacgacgtagcgttcagaggaccgagtgggattccgatgatatatcggtttgttacataaaaaaaaagaactatttgaaatgtttgctgatggaggtttgcagccactggaaaacaagccgcatcgtcagctacgactccttcgtcaacgtcccgctgcgtcggcatcaaacggccagattccatcgtgcgcatctgcaccaggcactgctgaagcatgtccctagggacatcatccacctgggcaagaaggtcgttcgcgcagaggtccgtgatgagcgggtggttgtgttttttgctgatggtacgagtgcggaaggcgatgtgttgattggggctgatgggattcgttctgtgagtacatacataaccccctacctagattgagtagcgctgacatcaagcttgtagaaagtccgacagtcctttgccccagaccaccggttgcgatggacaggcaggatcttcatgcgctctacgttcgatgcctcgctggtcgagggcaaagtccctgatctgccgcctgattcgacccattgggtgtgtgcatacacgaaatcatactataccttctatacctaccgtctaacttgatgcagtggggccctcgagagaatttcttcgcttcaaagctcggtacgcaatcatctgattgaagactttaacccgcttactttcttactgataatacgtaggcaaaaaccaattcaccgtcgtaggcagctacatcgacaaacgcagtccagaagagctagagagacaagtctcatgggaccaggaaggcgacatcaagttgctgcgggagaggtacagagtacgtagaacataaaacattcccggtcgaatctatacttaatcattgactattacttagaactggaaccccaccgtcaaagccctcgttgaccgcactccctacacccgcctctatcccaactatgcgggcgatccccttcccacatggacgttcggatcccgcgtaacgctcgtcggggacgcggcgcacactcacggcggcgcctttgcggctggaggatcgctggcgctggacgatgcgtatgctctggcattggcatttcgacacgttttcggctctgcgtcgtcagccaacgtaccactctcacctgctgcagctatcagcaaggcactgaacgtntacggaccaaacgcgccggccacatgcagagcgactgctgaagatcgtcctggctggcatcgataaagcatccgccgagcagacagcggcgctcacagaggaagaagaagaggacgctgcactcattgcgagaatgacgaatcgccctgatactacctggttgacggagcatgatgtggaggaggcgtttgcgcgtgttgtgcaggccagagaggaagtacagaatcaagaccagagacgggtttcgacgataggacaatctgatttacgcgagagtaagctctgagatccaaattgcactgctgtaagaatttaagaagatatcattataggaagtcgacaaggtgtacagtacattaggtatcaaggaggagcaatgagaggaagggttagaatagtattagtagtactatgatgataataataatgaatttatacctgattttacacacaggtctacatgtttctatgcacgatgttccagttctaactccccaacacaggaaagaaaataatggatgatgagtcatgcagtcattaaagtgtctgtaagtattctaagtagtcaagtagctatggatagtcctttgtgtaatgaaaggatagtccacgtgcctcgttaatggaccttccacatgtgatggcgtggaggatccaagtacatcgtagggtgtggccgtccatgtcgctgtacgcgacagtgaatgcaaagattagggaaaaaaaatgtcgaaaatagtagaaaccatagaatatagtaaatatcatgtcgagaacggtctccgctatgccttccagcttgtatattctcatctgttttgatatctgtggttgacacgcggcaatctgtttattcaataaatacagtgtacctaggatctttattcaaggtcatccctggctacaatgttttcttgttgctctgttctggctccacattttggaactagtgtagaaagccagcaacatgccgcgttaagggttgtctgtactgatatatacccttgtcagcttagcgggtggtataaaagggatctcaagcctgttcttgatcatctcctggttagatagtcgaattctggtatcgtctcgtttgaagacctttcttcctgcaattttgaagatgtacgatactttctacttagatagagtctatctagtgacatccatcaatatccacaagaagaaatgtaatatcaaatttgtcgcgactgggttcgcacggaagtttgtgttcagcgtgttccactggatgaaagcaagacactagcacatggcttctccctgagtcgttctaatactttttcacggagagctggcaggggatcatcaggaaactcatggccttcatgcttttcgagtgcaatttcctgaagcttactgaagtcccacttaagccctcatgactgcaacttgtgcccaaggcatcaattcgaaatctgtccaaggaattcgttcaaatccagagcggggagtaaatattaatgcttgcaaatcgttgtgggtgtgctctgcctcgacgaaaattaggcatgacccagcatcatcttccaagttgaagtcctcctccttaggaaattgctgggaagtgaatacagcatcccagacagattgcaagatggggaggcaatccataactgcagaatgttagcgcaagaagcagaataattggctaaggttcaaaaacctagcngttttcataccactgcatcctcacagtctgtaaggtcagcatccatcatgcgtcagctctagcatgctactcacgattaacttggtgttggtgttgcagctcttattcagtgagagaaaaacgatagccgaatccaaaataaggcttgactggattctgatgaaaccttataataagtaaagaggctcagctgtcgtatccattcttcaaacttcgttgtcataccataatagccgagccagaactggaatactgattcctaacataaaaatactcaaataattttgatacctatctcatctgcgcagcactggcaagacatctgtggtacaatacgcatgatcccagaaacctacaaaccgagaagcctcgccttgatggccattcctgccacaaaaactcctacgccgaccgcagaaccgatcaacgcaacaatgcctccttgacgcttggccttttgatcaagagtttttatccggttctccaatcctgtgaggtggtcctgtccgttcttcatacgctccatctgttcccaagtgacaaagcactttttcttttcatcaccaattcggagttcggcggcgaggaccttaggcaggatgcgatcgatgttataagggaccacatagtacaaagcatggatagtatcgacctataccggttagacaagtaatataagggggctctttgagagcagattcacctctactccttgcagaaacgggatcataggtctctctcaaaaaaaaattgggatcaaaatcttttacgttgaaatcttcgtcttccctcaacggtatccagccatgtgtcttgaattccatgacatacttccaagtagcgccaagtgtttccatatcgtcctcaacaatgtaaaataagaagatgatggcacgttgatgggggttcaacggagattgaaatgttggattgcgtggatcatattgtggaacagtactcataattatactctaatcctgaacctggggccaacgacgatcttgtggcacacctattcttgaacctaatcatggaaatagcgccagtgtttcatatcgtcctcaacaatgtaaaataagaagatgatggcacgttgatgggggttcaacggagattgaaatgttggattgcgtggatcatattgtggaacagtactcataattatactctaatcctgaacctggggccaacaacgatcttgtggcacacctattcttgaacctaatcatggaaatgtatcagacacatgatctatcgcttcttgagctagcaaacgggatatgcaaccagatcgtttggttacaaaatcatctgacaaggaataccagcagctaatgagactagaaaaacatatgtggctctgattacgtctctgacgatacaccccttctttttgcagcccgatcacttggggcctcacacgactgtcttcgtttccatatcgacattggtggcgtcttgtaaaatgcagtgttcaggagaccttcagactgttagcaacgacttccaagagataagggtcacgtacgccaattggagtcttcgtcgacttcaggctcggtctctgaaacttcagtatcttcatgatgttgagactgggatgcgtgtggttccacttccctccaaccaaagagctcggagaccaaaatccgatactcagtctcaaaatattctcttcctcgcacttggctttgtttctggaagtagtcacaatgggtaacgattcaaggcaccaagcgcctagcatacctggaatgacgtggtttccctcgaatgatggagaaccgtccccgctgaaataaccgaaaattcactgacgtatgtttcaggcagcaagctacagacaatggcgcatcttatatctacagtccagagtgctgtcgcctacaagggtaaaatcaaattccagaatagagagtacttgttcaagtcatggttctcaacctcgacgttactgcgcagatgcgacgatgggtgccctcggcgggaaactagagcaaggcaatcctttccattggtataattcatcagtaactctatacgcaaaaggcagcgtaaatcacttgtgctgaggttcttgaatgaagcttcacatagagccatcaccacggatagcaccaataaatcaaccgaaaacaggcgcgcctaatggccatctcaagttcttttagaaggacccactgaataattctttagaattattcagtgggtctgaacgattcaaatgcgaccatgatccgttgcttgaatccattttattggccgtcatgatcaacaaggttcatcctaacaaggcggcgcttattattggaggaatttgatgttataaagggtttaagggttagcaatggtggttagggaaggatcaaggagtcctgtcgactctatgccgtccacaaactcgcgacgatcgagctgatccgggtctcttctagagacaacggcctaactggcgaagggttcttcctcggacgacctttcacgaggtactagatgcacacacaagtaggggtacttcaatagcagatgagaataacaacgactaggtcagaggcaacgcctactagagctataccgaagtatataccactagtagtaagaagtcttactgacccccagagtaagtatcttagtaacgagtgataattgaatgaattgagcgcgagtagtagaaggctagatacatgaggttgagctctcttttataacttctgttttggtcctccatcttcttcctcctatcagtccctgttggactttctcctcgtggtccatattggacttcccttcttatcttatcaatggacctccttgagtcacgtgaccttgtgtgcctaaccctttcagccttgcggggtagtgtttcatcctgtgtcgctgtgttggacagcactccattttgttggctcgtaacaatttcctaggagaacgacaagagttaaaaacatttagccatccctcttcggcacgaactcagccctcatcaaatcatcagattaactgaataagcctttctagtaatcatgagatgcgctacatagagatatcttcaaaaaccttgataatatccattattatgctgaacgtctgaactcgcaacccactcttgtgtaaatgggtgtgtgctaacctgcgccggagggaaataggggtttgattggctgcgagagacaaggagaatcggccaccaaagtactcctgtagttattctgggaatttattgaatcaggctcccgcaaggcccgtctgtgcatcaacataagcactcgtagccttttgcctcctcctttccccatcaaaaatgaatcttacatccgctttagaggttcttcgcggtgccggccgaaaagaactggaatctcacagtgcccagaccatcctcaggatgcaaacacttgtccttcccaagaacagccaccatgcgcagaagctcaagaaggtgaagattcagctggagcccacagttaagtaatgcccttcagtcatctcgcaattcggttgagcctgatgtcaggcgagaagtatacctcagcttacagcaacaagccgggcagatagatgggaatcaatccgttcaagttcagactacatttcctccagaccagcaaggatcagatccacatccgcagctgagaagtatgtcttcggggcacacttggcacgatctcccacatccaacgaattctatcgtggcatgttatcgcggagaatggcagatgaacgccccccattcaccttcacagccatcaagcccgacgcgtcaagaaagcgaagatcctcacactctcggtatcaacatcagagagacttctgacatacttggtaatggtcacgctgaagcgcaatattaggtatttttctttgaccatctcaagcacaaagaaactgccaacaaagaggtgcaggtattatgcgaatatatataagatcaaagtatggaaaagaagtgtaaaaggtaaaggtgttctgtgaacatggccctttctatcgtacagtacatccagtacacaccatggcagtcaaaacaatcatcaataacacattggcaaacagagggcatgtcattgggaagatctttcgatgaattgggaatggctgacgtcacccacggctcccgcactagccctaattagggttagttggtgggccgataagataaggagatatcgcataccaaaacacatctatcgtcgtattattcctgcatctcgtcatgattattgtcttggggcatgtgtgtcgcttcgttagtggacgctgacaacgatggagggaaactgtgtcctaggtcggatatgacaacggtacgtggatgagtatcactcatgggcatagctgcctcgacatcgcgagaatgtgaactctctatcgcaggccgtattcgggggaagagcgggaagggtactgcgccggtcaggactgatatatcccacacagtcagtatcaggtccaatcaggaatgatgcgagctaaaaagatctgtagagagagagactgtggaaaaggaaatagtaggtagacctctgaaaaagacacccgcacgagtatacatcctctcacacccctgtcgggcaacaccgtacagggcagaaagactgggcatggccgcgacgcattgaaggagggtttgcaggatggtcagggcaagttcaaggtttgcggtcgacatgctgactgactgaaatttcagcgaagaaagagagattggagggaaataaacaattggatctatcgagttgatgtcgagcgaggatggaaaatccagtccaaaagtcagcgaaggtagcatttgttccattaatagaggcgtgagagtgctttacaaagcaggtcaaatcgatagatgatagagggtgatcgatcctgcgctttttataataatccatgagatgttgcgggggatgcaaatatctgcccgtagtttacgtcctgagaggcgcccctatgatgagcatagctggggttacagctcagtgcagccagaaaaaaaaaaggactcgaacatagcctctgcatgatctcggcggtggggctaggcgtcgctatccgcagggccgcatggatatgtgtgtcacttctaccgctgcaaaggattggtaggaccgtaggacgcttgtaggattctcgcgggcaaggacgggatccattttgttggcaaataggcacccttttctggtttagcgttcccctcacacgagccagctgaatcggtactaactactaatggcttacctgcggctggagcagccagaaaaaagctccgatcacctaccgagcaaaaatctacgagcacccagtcaactagccttccggttctagtaggtgagcagcgccgccctgagctcacctcatcggaggttggggggaggggggggggagaagactgaggaggtgatgcaaaacagaatccattctgtggataaggaagacttcctatatctctatcctacagtccatcaacatgctttaccatcaaatattcgaagcggatttgcagcaactggcctagttccattatcaccagaaagagtgctttcaaagcttcatatccagctaaagacaccaacaccaccggtgatctacagcacatagcaatcaatcttttaatggcccaggcaagacaccagctaatatgcatcaactggagcagcaaaagaaacaaattcaacatctctgaagtcatcaaacagtatctccatctatggtggtacaggcagttgataaggtgattaaaggtgcagagatcaatgcagaacaccatcctattatagcaagaagttaattagctttgtgcatcaaatcaaagtcaaaaaaggaagcaagaggcagatactttatagcaactggtggcagtttaacaggtgctgaaggccagcaaagaggtcataaacatgagatgatggaggagcagcaatcttctcggccacgcaggcgaattcggtgcagtaattgcagtcaagagggacataattgccttagatgtcctaataaatagaattagctttaatatatccaaatgttgttgctaaaagcctcaagatttatggtcgcgttggtggttgaatatacataaatttttggggagaccgcgcagctcggtgtccgattacgttaataacttttaaagtaaagatagattaaaaagtagctaaaaaagactaatttaagacttataaaaaggcttttaattattaaggtatatttaagattaaataaattaaaatatttttttaaatgttataaaaatgtataactagaatctatatttatttaatagcctaatatattagtattaataaggttattaaatatataattgttatatttattataataatagaggtaattatttttaaaacctaaatgattatatgcttataaataataattaagagacttttaaataattatattctaagtgaagttataaaataattaaaataattaattagctatattaataataaaaagttatttaaatataaaaaagtgtctaaaggttaataaaaaaggttaaaattaaatattattttagcttatatttatacttacctttattaataaagataataataaaattaagtattaaataaaaaatatactttttactaaatattttccactttttttaatattaaccttaagaatattaaaagctactattagtatatttaaacctaagcgttatttataaggggtattattttttttataaaatactaagacttactaagatattaaacctacttcgtattaaaatgcctttaaaaatttaggaaattttaccctaactttacccttaaaaagtagtaattaagaactaactagctaataaaaagtattatctcttttttaataattatataagcagttagagagcttatatgtctaaatatacgatttatatcttattaaaatatatattatttaaagattaatatatttaataatatttttattaactttaaatattttaaaagttttaataatatttcttatacttaattattatataatttaaaaaattattatataatttaaaaaattattatataatttaaaaaattattatataatttaaaaaattattatataatttaaaaaaagatctccttaattataaattaataactccttttatagatatataataattataccgttttaaagaagaatgtaaataaaatctattagtagaaatatctagttttttattaatcattatttttttataatattaattttattaaaaaattactataatattattaaaaaataagacttctaatatacctcttactttattttatctaaatatagacatattgatatatttaaccttaataatagctttaaagctatatagattaacctaatattatttatatatatatttaagatatttaggttaatattaaattaataattagatatttaaaagtctaattagattaaatactcttaaatgttaaatatagttattatttaaagttaatatagttaattaaattattatactatcctttattacagtgtttaattaaagtgtatacataatttattttaaaaagatatatatatttacatagtatatctaaatgaaatataattttaaaaaggtaaaaaagagttaattcaatattctgcctttaaaataataaatatacttttatatcttaagaactttttaaagttatttatatatattttttttgaattttctttttaaaaaaggtaattaaagatttatacctttatatatttataatataaagctaattatagctatattataaatattataaaagatttataccatttttacgagattaaaatattcatcaaagtctttacttttaggtatcttaaataatcttaaattcattaaaccttttatagccctcctttaataagagttatttaatacaaatattttaaaaaataatgaataaacttaagtataaatattatatatatctaaatacttagagcttgatattcttattattaacataagaatagggtaaataaaatataagggctatagctaccttatattaaaaaataaatatattataatttaaataaaatattaattatttacattattaagcttaaaggtattaatataattttatattaaataatctaggttattatttgaaagttttataattaattaaaagaccttttatataatctttataaataattaattataaaagtttattataggcttaattataatttaaactaatcctgctaaggcctggaattgcttgctgatatcggccagaggggttcggagtgcttctttattccctaagggtctctggatgactcgtcgttgctgtttggttataccgcggcctttgctggcctggcatggtgccttaccatccctaaggaatctagggggatcctgaacttcttcatggtttccttgatcattttcctgcccggtctcattcatcaccagccctaggggccctggaatattccatcggcttggggttggggtgtctggtacctccaggaactccgtgagctggcttgccgcgtggccgtttgccgggggtgacgcgtgaataacaccaccaccatggagatcggggggatccatggtggtttctcggggcctaggggcctctctgagttgaatgacgcgttaagaagacgtgttttttgtatgtgctgattttggtgttcctcgcggagctctatcggtttttgagggagacttaccccctcactatactttaaaatgaaataaatcatatttacttattagaatataatgctgatttctcttaatactactagtaatacctgtcaggctcctggcactgacccggctggcggagcgtggttctcaggtcacatgatcccgcttcacgtgacacctcgcttcgcctgacccacatagatatctctctttgtctacgcctctgaatttcttcttcttctccttctctctcttgtcgattttgccttttttcagatagagcagatagcatgaatcaatgcattttacctttgccgcaaggtcttgataatacctaagaactagggcccattcagcctataagcatcttgttgttttataggatgattttgactatagttacactatttaatatcagaccctttaggatcctgcccattatatataaactactataggcaaagcctatataggccaagatattctacttagtaggttatataggttgatgtttcatctagaggttcctttagatcctattgctatctaccttacacctaggaatagtgattatgaagttccattaatcacagtactattagatagctgccagtgttttgccgattacgtccctgccctttgtacacaccgcccgtcgctactaccgattgaatggctcagtgaggccttcggactggctcaggggggttggcaacgaccgcccagagccggaaagttggtcaaacttggtcatttagaggaagtaaaagtcgtaacaaggtttccgtaggtgaacctgcggaaggatcattaccgagtgagggtcccctttgcgggcccgacctcccacccgtgtctaccgtaccgtgttgcttcggcgggagggctcgcgatagcttcgcttcaatcctcagctattattaaaaccatgttcccatcgaagatgcacccgaatttatcaaaagagcttcgattggcgaaatccaaattggcgttgcgaagggagctgtaccctctgcagaacaaggcgaagagctgaagagagctctgcagacagctctggagacacaagatgctatcgaaaagctctcccctgttgagaaggagctcatgtcccaagcagcccaggcgagtctccggaaacgtaacacaggcaagtagtctgccaaggaagagcacaacggcatggagaaggatactcgattgaccaaagacaccatgtgaattctttatatagcctagcatgcgttgtgaaaccagtcaaaaccacaaatctatccagagcaatggcatggatcggagggagatgcatgatgacctggccatatgcagtccaacagtgcttggcttttgcctggacaaaaaactttgggatgagcgttcataccaatgggacagtgttgagcttgggctaagtgctggtctaagggaatttgctgtcgagaacgttgaggagatcagattcacagagtccccttttgacatgttaattatccccggggataagaaaaggtcatcaaatctctcaccgagagccgtgtcagcgcgacaaatgaagcaggggcagggtgtcatcatacttttgcagtatgtttcttctttgcctgttgtatatgaagcatgctgaacacgtgacagcggccctccaggagtggggaagacgcttaaagccatcgcggaacgaattaaacggccacccagtatgtttttttacctggaacaatactcgtctcctaaccatttttagatctcctctggggatttaagtacacgtgctgaggagctggaagtccagctcactcgtacctttcgcattgttagtgactggaaggcggtcctcttcctcaaggaggccgatgtatacctacaacagcgagatagtctgcagctgggacggaaccaccttgtcgctacattccttcgcacgcttgaatactataatggaattttcttcctcaagacgaatcttcttaccaactttgatgtttccattcttgatcgaacccacctaaagctccggtatgataatttggattcctccgtccattggggtattttcaaccactttcttagtgaagcaaaggcagatgttaaggaagaagagcttagcacatttgctgaaatcagtctaaatggtcgtcaggtaagtattcaacatcacaggacagggaacatgccaatgcaatgaccaaaccagatcaagaatgttgtggagattgcccgcaacgttgccataaatgacagtgccaagttgtgtgcagatcacattcaaacagctctgacagcgagtggatatgctattcctactaagggtgcattgccatttgacaatagcctgtatgaataagatctcctagctgtgccatcggggaatgctgggacaatttcgcgagagtattttgcatccatatgcgccaatccccatatgagtaatgtctccaacaatccaatcaccttgggaatgcgatgagtctgtgtcccttgagcacacctgtcacttgccgctgtaccttttcaaacctcatgaaggcacatgtctcactctctatgtggttaaacagcccagcgaccgtttggaactgccttccacatttaccctttgaatttgggcaatgatatatcctttgcttgtgtacaggtgagttgacatgggcattcagggcacccttggtgttgaactttttgtggcatatgtaacactcccagaataagccattgaatgcacggtcggtagccaagtatgcgacatttccctcctcataccattcaatctccttgttggtaatgactccatgtgggtcacgcttacaaatggcgcggtagatggtttcacggttataaactcaggggcgcaagggcagcaacccatctcaaggtggtgggcaacaccgctggcagaggtgtacttggcgctacaataggggcagggtatatttatgccgtggtgaattttggagcggaggtgctaccagcaggtgtgtcagtatttttgctctgaagggttatatgtaagaaaccttaccattcgcagattattctcattttgaaatgccaaatggcaatcatcacagtagttcttgtagtgaccaagggctctcatatgctggtctgctgcgttttgtgtgtggaacatttttccacatgtctcacatggaactttcggtctccaatgcctaagtgcgttcatatgctgatctgctgcattctgagacttgaagactcttgggcatgtctcacacttaaatgtacgggggcaggtctggcactcatacatttggacagtgataatcaaggtgatgaccttcataaagtgggtgaaaacagcagagagaaatgccttgcaaaatgggaaagcagatgattaagagccttggagctacattctaggaagcaagggggtaataagcaagacatgcacagttgggtgggtgcttagatgaaagaaaagaggttcttaacaggggtaagaactctgcatcatgcttggatcaatcatttctggccacatgtttgcgccttactgtacatcaacagggatcctattctttacagctgtctcatgatcctctctcatggcctcagaaggactctcacctaagtgaccattccaaatacaagttagggtattaagtggctgaactctactagcaaggctgaagacaagattggctaagttaggtgaaggggaacttagccatcccagatcacctcgttgcttctttctctgattgggtggggtagaactgtgtgaacacctgctgacaatgaccatgcttatgcctggcttcctaagacaaggttggtggatattagacacacaaagaacaggatgacagacgagatgaatctccaatgtagtgcaccagattggcatctttatagcttctaagcatatcatccatgaaggttgaaggcatcttccgttgagagggcatgcattgtcagtaatgtccttgtcctgactcttggagcctgagtcaaaactgcatcagtgaggcggagtgttggtgtcctgtcacatggtagataggctaaccttgacgccctctcgcaacgtgtcaccctgtaaaagtcaccaactgcatttgcaatgaggtttgacaatgcaatggcccaagcacaccctggcagtgttttacttgttaaggatcgctgcgggtcccaacaggcattttgcaaaggtggcttgaaaagagccaatgagagacctgccaacagagggcgcttgggctcttgcttgagtggtctttatacagagtagggtactttaagggaccctcttcagccttaaggcgatttcctaatgacgccaaccagaggggaatccaaaccttagggaatgcctcaccctaaggtaccacgttttgctgactgctctatcacaatcatgcccatgctattaaaactgtggtctaccatacggttaccaactacttacggttacccacaccatagggttgagcacttttctaccatgttatggcataccatgtggttaactatcatatatggtgagttttaccatatggtttgctatatttttattaaattatggtctactgtatggtcagcagcctcctatggttgcccacaccatagggcaaagtataccacatggtttgctagtttttctaaaaatcgtggtctaccatacagtcaacgaacctgtcaaggattctctaggctcaatgggttttccaattctgtaatctcatctcccattgtccttcttgtcccctcgtctatctaggtaaaattcttctctctttatatacatcatggacccctgataggcatatcgtggctttcaagcggtgttctttttattggtcatactcggtgcggggttgttcgtctgagacgtaacacgttttggctgacacgtatgaaacatatcacgttttggctgacagaacccttatggttacctacgccagatggttagctatcccttatggtttgccatgttttatccatactatggcctactatatggttaactatcccgcatggtgaactataccatatagtttgcagtatttttaagaaaattgtggtgtactatgtggccagccgccccctacggttgcccatatcatagaacaaactataccacagggtttgcagtatttctaaacatcgtggtctaccatacagttaacaaacccttatggttacccacaccatacagttagctatcccttacggtagacagtaccatatagtttttgtattttttacttaaatttatggtctactatgtggttagctattccttgtggcttgggctgccacacacgttagggtaatctctaacccacctaggtagttaactattcccctcgctaccctagagctagacagattagttgaaaacagagctacattctgggcccatacggttctttttcccgcgtggtcagccataattctgtgaataacatggtccacgtgccagttcgtagtcttaacttatcagtgtataaaatttttaacttaaagagcataacgagacaaaatcagaatacactaatttctctctcccacgcatctttgttgtttcctgaaatggccagtagcgttttgcatcttcaaatggtctttttcattcaataagggtctgagagaacaaacgcttgccccagttagaagcggagttagcagtgggcggctaggaacaaccaatagccgcaagcctgcagaaatctgccgcgccaataggagattataaataaatcaaaactatttagaggtcatatcacgcggagtcgttttggatccggcgcctcaatccggcacagtgatctcttgagggtggccatgcgcttttcaactagttggcgatccagtgcgcaccgatgaaagtcaatgattagggcccgctgtaattcagaattcgacagaatattatccggccgcaggtctcgatgcatgacatatcatgggtctcgatgcatgacatatcatgcaagttatcagctggttgagtcccgcctaagccactgcggatctacatatagatcaccccagaatcacccctgcgctcttcccagctcggcaagagtgtaccattggctgccgctgccgaaaatcgctcaatccggtctcctgttttggaatctgcgatccatttctgttgcatctctcacttgtaacgggtgagtatttcgggcttctctctagaggggttgacgatcaaatttggggattatgttggtgaagtttctgcatagacagtcttcagaggtgccaatatgttagctaatttataaactttcccacccggcaagaacggtacaagtgtgaactatttagaaagaaagatagtccgggactcagtctgaagagaccatagtctggaaagactcagtagtctgaacaggctcggtagactggaaagactcagtagtctgaacagactcggtagacggaaagactcagtaatctggagagactcggcattctgaaaaggctctgcagtccagagagactcagtagtctggaaagaccgagcagtccaaagagacacggcagcctgaacagactcgaaagtctcaagggaccgatagcccggaaagactcagtagggactgccaagtctctccagactataggtctgttcagactgccgagtctttccagtctagcgagtctgttcagactactgaatctttccagactcctgagtctctccagactcctgagtctttccagactatgggtcttttcagaccgccaagcctgtttagactgccgagtctctccagatctttgggcctctttggactgctgagtctgttgagactattgagtcttcaaattgctcagcctcttcagacggccgagttttctagactagtaagtctatttgaactgcagtctcttcagactgagtcctggactatctttctttctaaagagctcagacttgtaccgttcttgccaggtgggaaagtttataaattagctaatattttggctcctctgaagactgtctatgcagaaacttcaccaacataatccccaaatttgatcgtcaacccctctagagagaagcccgaaatactcacccgttacaagtgagagatgcaacagaagcggatcgcagattccaaaacaggagaccagattgagcgattttcggcagcgacagccaatgagacaggtagctgaccaagctgatgcgcagcctagaagatgcgcactaccgcggtgtagcaactgcaatgttcaaggtcatactagggtcagctgccctagtaaataggcgattattttacatgtaaatagcttcaatttaggggtggtgtggtgagataattagatatctaataataatggcgttggtgggtgtttcgctcggtgatctgtttcgctcggtgattgattacgttaattggctttagtaatctttacatacccaacacacaccaaaggccgacgtcattaaagatcaattcctcaaagatcagaggggagataagtaataagcttggaaatttcctgtaggacttctacgtagcagtctgtctgactggaaggaaaatccggattaaggactcgcaatcagaaaggcatcaccctacgatacatgtatatatatatatactccgtataaatgccaaaacaacattcaacacgatagtctgatccctcagcactttctcatcttatctatctccaggtgtcttattcgttactaattttgttccatgaattgcatatatagatggtctgccgaaaatatttgccatcctgcagtatctttgtatgtatgtgacaataattattccctcgactgggatatagtcgttgaaatatgtgatcctctctatcatgaagaagtagcaaggttcgattgctccaagatctccacttaccttactacatggagaacttggttagaggagtccataataatggaaccttgaacaaatccttttcactgcagtcttgctttgagatatatatagttagccggtgtaacgccctctctttttttttattatccttatccttacgctatttatacagctggagtgttatggagagatttgacttaagaagtcatacgacttcagtaattatgttgaagaatccattcgctttatggcttttcagctggaaaaggaatatggctcatttctcctgccattatatataattcacttcctagaatccatcaagtacatacgaccatagggtgtggaaaacagggcttcccgtccgctcagctgtacttaagccacacgccggctggttagtagctgggtgggtgaccaccagcgaattccagctgttgtatgtttttgcttgctcatttttttaccagcatgtcgttgatttgctccatactgctagattcaggggcgttcggggaaatggctttgcatcttgccgtcgaaaccgggtaagaagccattgcgtgttaactcatcaatagagggacagatattcttaggaaaggaacctctatgtatgtacagtacatacatttctagttatttctgccgtcatcaataatccaaccaagtatcagtccgacaagcttgtagaacatgggagtacttgcgtagcaggtcccacagagattgatcaccttctgtaagatgtcgataattcttgccaggaagaccgccctgctgcatttgggccgaatcggattttctgcaaagtaaaacattgcccctttcataccatctgttaaaggaaaagtcgccaaaggcaagcacttgaagtgattgaatgcctttggatccaaatgcccattgcgcgaacttgtcaagatgctccgtgagctctggaaatctcttttccttagatgatgattcgccactactctcgtcctcactagattcactgctgtcagtctcactcgttctagactccatttcatccgattcaccgtgcggatcggtttcagaaacgccataccggactccccaactttgcaagtgctcaaaatctgagcccgactgcctgatgtgtaaaacgttcaggcaatttttctttctaaatggagagattatcggcttctacaacagtagtgtcggaagtgttagcttattatatcactcgtaatttaggatttgcaggacgtggtataccaaatagctaggaaaacagcaaattccaatacattccaagtcgagaccactaaaggggttctgtgaggaatccttcatcaacgtcacgatatcatcgggcataaacgatagatcaagtcggtcggacggtagctaggataccatattcttatagttctcttattctattgataggctatagtaaagctataggatctggcaagtttttgttactcctcaacgttctgctgtctctcctcctccttatcagatataattatataaataagtatatgatttcagtatagaagttaatcaagatcataccctctataaatacaggagaaaaggattaagaaaaagaacagtcaagcaatcatatgccctgttatcctatttgaggccctgtgttctcagtcacagtgcctgcagccctgcccctaactcaccctgctcacccgtgctcgcctacactcaccccttgcttgcgcgactactacacttgaagcagcgatgaattcagggccttagctcagccacaccaagttgaaggggcacccaggaacaacaattttcctgttccaaagtagataaggtgctgtgtttgacgcaatatcattggcgggtagttagctgaacttgatgacgtgttctctttcgaatgaacaaagtgaggagagcctcctactgggtcttcatctacagctttggttgtggatttgaatacatactccgtactgaagtccgaaaaatcatgcagcctgatctaccaaagagagaattttttgggaaaaatatcaattggcgatcgtgggatgcaataagcaggcactggattctttccaggggactcttaaatctagttagtgtaccaacctagtaagtaggtagattatgccgctgtttactgccctcgctaaggcgacctccgccacaaataatgtagtcagcgagtctaggttaactagataaaaaacccttctcagctctctggaattcagatgtcatgttcgtgaatggtttaatattcgtgcgctgttccaaagttgtcataaagtgaattagtagattgtcgctggtggtccgtgcgtccctaaccccggtcggctcatcgcggggaaaagcttagcttagctagctccaactaaagcttcacttcgcgccatcctcaaacattgtagtcaccacttgtttccggcgttttggatactatgatctcttttggtttctagtcagaacttccctcggttttggaggtgattgtcgactcactctggtttgttggcgttgacttgcgacagtcaccatgagcgaccatacccaaggtgcactgaagccttcgttcaagtcaaccgagtctggctgaaacttgctggaattttctcctaacttactgcgacaagatgcgagagagcaattgccatgccagtcaggtgacatctgacaacgactggtcttttgctccaccacaagtctcacctccccgtctgtcgacgctgatcgaagaaacttccacaaaggagggcagtggggagaaggcagaaacgcaggcaagaaatgatgtcgtccctgtctcgacaatagcgagacaccctgataccgccgacaataccgatcctgccttgctcgaagaagccagcttattttccacgctggaccgcgagcaccacgatcgcctcacacgatatattgcaagccatctgttcattgtcaacgaaggtctggtcgtgcgatggctggatggcacaaatttacacaggagctgcgtgcggaagccgccacagttggactggacgaggaagctattcagcggctgatcagcactatacagagggttgtacgaggaaaatgttcactatgatgatggttctgtgtttggggttgaagagtttgatggtgtagatgacgggaatgtgaaacaaaagaaacgagaaaggagaaattgtggctcctccggctctgcgaagagcgattccaagaagctgagaaaaacagtgctggaagaccagaagttccctgttgaagacggatctacagcggctttgagtacagagtctaatgctgacagcgcgattgcggcgatatcagaggttactcgagaagctaccaacacatctgttccatcgaatcatgagatctcagatgtgaacactaatgcacttgaaaccagagaaaacaagaaaaatgcagctccttctgatactaaggcgcagaaggggaagccctggaaacaaaggtccagaccagccaaagtcagccaccattttgctaagcgcagagaagggaagtctgtagccagcaatctttccggcagaaagaacccccagcaatcaaaatcagcaaatacagacaaatgcagcaaggcagacaatgcaaaaagtaaggaggcctgcgaagcgaccatcaaagcaagatgccatcgcaaacgcgttcgacggagagaaagactgagagcgacaaaagcgcaggaacatgctgcaaaggatggacggtcacaagcgacagactcaaatgctacgagacgagacaagcaatctctggctgatacggacatgccagattttcgagcaccaatgatttgcaaggcatgacagccagtgatgaggtgatgtcgaaatattttgccaagtctacaggccagaagggaaagaagactaatctgggagaagtagaaacaggtgctactgacatctacactgcactagcttttggtgctccagtgcctgctggtatagatcaatctctccttgacctgttgttgtcttctgattcttctctaagcaatgttcccagcgacatgagctccatcactgtcgacacttctcccttatctcctcttctgagacaagatacaccaggccagcctgctgaagatctaagtattcctcaaactccaaccaagtccgcacagcctccggcgaagaaacctcagaagcttccaaaagtttcaccctacttccctaaaccttccagtgacgcagagtcgtgtttgcctttcccacccatatcagcagaatcatttggcttgattcaggaacagctagcacacaaccctttccgcctgttgctggccaccatcttcctgaaccagacccgcggaggtgttgccatccctgtccttttccatgtcttcgggcggtatccgaccgtcgaagccatggcagctgcagacctggcggatgtcatcgaaatgattcattgcctgggtttccagaaaccagcgcgcgaagaaatgcatcaagctcgcaaagacatggctggtggcgccgcctatgaaggggaagcaataccgcaagctcaattaccccaagaatggcgatggacgagacgtcggtccggacaagtgcatcgacgacgacgatccgcgcgtcgcatgggagattgcgcatcttccgggcgttggggcctacgcgatcgacagctggcgcatcttctgccgcaacaaactcggcagtctggcgtcagattggaagggcaagtcggcagagtcagaggactttgagccggagtggaagcacatcctgccgatggataaggagctccaggcgtatctgatgtggatgtggctgaaggaaggatgggtctgggacagggagacaggcaagcgaagtcgagcgagcgagaagatgatgcgggctgctgagagagggggtcttgctcatgaagaggacggcaattgggtgttggagatgtctccagtaaggtgtcgtcttacatatgaccgtatgacctgttcgtctttttcttgtatctgaaggatgtggtgcacttgtaggatatgattggtgtcatgactctaattcaatatacccccttcttatcgaagtatatatatggctactggagtatcccttatagattaatattagtatttctcagccaggtcaggacgatataatgcgatgcaacccctcattgcgatactgtctagcgctgaactgctcaatggttttcctaagctttaagacattcagttattatagcaactattactcagcacagcctggaggctgtattcgacagtggggcaatatcagcactaatttagcggggtgcgattgctgtcactaataataaatctaccctgcagccttagctagacacctagctaggtattcatctcaagtttcatcagacaccaaacctacaaacagccaagaggatttgccatgacaatcgagcgactgatgttagaggataatccttttcggtttagcgtgttgccctcatgtgaccagcagaccgctatacagactccttacagcccgtataggccacgtacaggggggcatctggcatccccccaataagagataaaatgatttagctttgcccggcgccaaccaagtccaagtccaggcaaatacgaattggacccaggatccacacactccctcgtcacgctgctcttcttgttaacctcaatggtgcctagttctctgttctgggtccgactttcttttaaggacgtcctcatcccagactggtggaagtctgttgactttctcctccgacgacgtcagacgtcatggtcgctcttacacaaatccagtcgtccaacgcccagatcgcgtcctctcttcctccaggtctggttgcggtttttgtcggtgcaaccagcggcatcggtgaactgtcgctgaaagcattcgcccagcatgccactcaaccccggatctattttatcggtcgctcccaagaggcggcagatcgcattaccgccgaatgcaagtcactcaactcccaaggagagtatatcttcctcaaagccgatgtgagcttgattcgtgcagtggacgacgtctgtcaagagatcaagaagaaggagaaggcgatcaatctcctcttcctcagtcaagggaccttgatcatcaagaccggtaaatctcgcccggtggagttgtccagaatgtgaactgaacatgcatcatagaaacgtccgagaagcttcattttgcgaccgcgttggcctactattcccgcactcgattcattctcgatctccttcccttgctccagcaagccaccggtttacgtcgcgtggtaaccgtcttcgccggcggtaaagaaggttcgatcgataccgacgactaccaagcatggaaggttccgatgatgtccatgcgtggccatgtgagttcgatgctcactctgtccctggaagccattgcgcagaaagcaccggacgtgacgtttatccataacttcccgggagcggtcaagacgaatctggcaagagggggccaaggagtggccatggcggcgatcagggccgttttcaaggtcattgggccgttcatttatcttccgaatcaggaagttggtgagcgtcatctgttcctcgctacgagtgcccggtaccccccaagtaccgccagtggggttgcggtttcttccggagtcccattgccggaggggttcccgttgcaaagggaactgatggcaagactggtagtggcgtgtactcgatcgactgggatggggagagcgcgggcccgaagacggtggagctcttagccaagctcagaaagcaagggctcgtggaaaagttgtgggaacatactatgggggaattcacgcggatcaccggaaaggaagccgcatagattgataccatgtattcgtattcgtattcttggcgtatttttctgctttgatttattttacggccgacgaggctaacaatcattcacgaccatcaatcaatccatcaccttgcatcagcaggtggcttattttctctcgactcaaatcagtacctcttaataataggccgaatttctttccctttcattcattatgcttcctgttgtgatgactacaggatagttcattaaagtgggggttctagagtaataacacaggtttgcgccgctggtccgtcggtgtccggttgtgatgagaaccgcattttatatatactggtgtatattgatttcccaccctaccaggtcaactcagggggttgctcgtatttttcttaccagtgaagactcgatataattagtcagtttgacaggggtctatccgagtcagattttcagggtgcagctgagcaattagccgaaacttttagagcattgtctatcacccacgtgtcttggctatggcgtcttatttggtgaaggatacagattggcctgacctaatcgagtcaccacccattcgaggttattaacaacagttttggagttgatccctgcattcgacacagtgtttattaattttaatctacacaagcaatgccttcatcgggcactggccaacagagggtcctcccccgtcagccaccccggcatcccggcatccctgcaatatagagttacatacggccgaagctgaacacagcatcatcgatacgaggaatcttgtcaggccaccccggcgaatgtgttggatagggaaggaagcctggattcctacgaggtggcgcggccgacaccaaggctatatatacgcccatgccgactaagcgacctgtgagggcaccagggtcacactagatatcaatccttttctccaaagactctgtatagacttccaacagaatgccagtcagaccgagactgcgacccaacagacaggggtatgtcagtgagatcggtcatacgtcgatttcactcgttcactgaagattacgttccccaatctgactggccttgggcgacaaaacaaacatggtctgggagccttagaagtagtcaaggtcgaaggtcgacgggaaagacgccacaagatttgcccgtctcccaccattggtggtttgtcccatgatatctatccatcaagttatattgatctttgctggtgacgactaccacccctcagtatcttaccagctactttcttttctctctgtgttttcctgcagaaccagcttttacgtcaaattggaacctctccaccgaacaaggaatggaagacactctgacctaatgttatcccgatagggcgtattccgataatgacagaccatacatccataccggacttgggggatttttagagacggttgattgagagtctatcaatggtttttttttaaaaaaaagttaacgttatttacaaaattaacgttatctaaaatgtattcctttaggactaacattacaagaaattaaccattttcaaaaaaaatataggtttattattcctatagtttaactgcttagggatagggttatgaccaagatgggattcaaactctataaatttactcaacttgcaaaattatttttatagaaaagaagatgaggccttgatttctatgtattctaccactaggctatcctaaccatctaaattttgaagttgtggttgagagccaaggatgaccctgtaagggcaatattcttgcctcaaaatagcatgaagagaagggtataagaggcaaaaagcaagcagccaaaatggtaattgtgtggtgttatgagcgttcgtgttcataaacattcagaacatcgattgacaaagactcagtaacctaaagtggcagaagagctgaggagacacttcctggttcataattgctcacaatgtggcattagacttgtattccaacgcttgcttagcgtcagtcaagcgcacatggtggcagcccaaatatcaatcaatatcaattgatgaaggagaagctattgccgaccagattgatccaaagatgcaacagagatgcagtaataattgatggaatggagttcctgctaggcatgcagagagactgatcctgaaatctaccataataacctcgacggatgcctcgccatcaggattaaattaaatgcctaccgcccgacccgccattatgtcgatattgaatgggcctgggactggtgcctgaagcataagctgacgggacgagccatggctggtgccaataccatgcagcaagccagcaaaggcttcctctttcctttgcctttctatggcagtctggtcacttttagccttctccaaatagggtgagccaagctaatttctaattaaaatagacataagaagcactgtagctggtgtaattaagtgaaatagatggttagggtttcatggttgatatgttatggttgctcttgtttctaggctgaagcacctagcatttagaataaactaagttcacatcgcactagatgcatatctaattataaacactaaccatgctgtctcctgcgtcttgggtcttaagtatatctctataggtggtgtttggtaggtgctatgatacattgctagagccatgaggaggcctacaatcctgttcccctttggtcagagagctcgagcatgtgcacttatttggtggcagcggtgcatcaatgcggccggcatgacctctttcgcctgacactactggtgcggcctttcctcgccaccagtttcgcaacaaaagaggacagatgggaaaggcgagagagcaagggatttctcctgctgggcagaggacctgcaactgtacattctaaacgatagcctagtgggtctggttcttggctgattctgcctctccctcttaaaaacaaaataacgttttctgtcaatttctgtttatcgaacagagccttaccactgagtctaccccaataatcctctttgcacatccccagcagccggcgccggtatcctgtttggatccaaatcacgagaagcatcctttgctttgacaagctcaatccccagtcgtccaaacaagagttctagctctgagtatcttttgatagcaaggccgatgtactgcagattcaattcagccttccgtgccctagaacgagttgccgccgcacgatgtttgcccttgaataaatagaatggatcgaggaagcttgccaggccactaccgagtctctgaccgtttactgtgcggacagtggcttgtatatcactcatagtatattgggcaccttgaaagatttgttcagggcaaattcctgatcagatccttgctgttgacgttgagaacttttatgatggtattgccaacggcattctccatcaccaatcctccctatgccgattggtatatcatgaaagacagaccctatttcttgacaacgattattccgactcctatgagggtgacgccgattaccgccacgaactagatttttagatctttgaatataaaccctgatcaggatgttgcttcctttgcaagggctgaattgcgccaactactaagcaagtgccatctcgaatgtattggactgtgtgagcggcccgaagttttggtaagacttttcctgtctgatgtcattcatataattcatatatataaaaatttgccagtcacagtgcagctgacggcagttaatattagagaatgcgactccagcatctggcgaccaatatgttgttgaaattactgcacatatgtgcgggacataatccaatcgactttctggcacccgaggtgattgccagtcagcgtcaatgtcagttccaccatatcaataaagttatcttctagaaactcactatcggcagttccagaaaaatttgcaatgtttgcctatctaatagtgctacagaagaggaggtcttagccttcactgaacgggcctttggcccaaagggcctccaaagtctcatcatattagcttacggcaactttgcagagggtgagagaaataatagttatatttattgcagaagttcggttttagagggaggatatgaaacatctgacaactcagacaaagttatgccttcattttggaagattacctgcggtaacaattcgggtcatgacagagatatccagaaagaccttatgcacacagcaatataagaagaacagagtccagactggaacaccatacgatatatttgcctgctacctatattatcatggtgacagtggtcatagcaccacagatacaacaatattggaagactgcgatctaaattccctgtcttaataatcatgatgccagcttcaaacaagaactttcttctgcaggaaccatatcaaccccgctctttcaccacctctgtacttctgcagaaatctcccatcgtccaaggaaaatcatgactgtaggaggctagctgatctttttcttcagggcagcaacagtgagagttgaactatgtaatagcggcaaatgcgcctaattggatactccgcccctccctcccaccacaaatatatggacttgggtgcacccatcccctttttagtgacaagtctatcatgatcgctcgacccgacccgatttcttcacggaatagtaggtagggctactttccgatatttgttcacttcttgatttttgtgacagtaagagttaaaattttaggtacaaaggccctgtgaaggctatagcaaagccctagtgaagcctatagtgaagcccctataaagtcttataaggctctattttataactagatctataaagaactttgtaaggcttcttagggctttactattgactttgctatgggcttcacagaggcttcgcaggggctctaaggggaggggttcgagcaattcggcacttgaaatttgactttgattggctgccgcccacggacagcgaccatcctttcctaagtagggaaatggcatgaaccttcaccacctatttcggtagtaattcttcgcaaaggaacctgcaagaacacttgtgattcagtaattggctatcctaaaatatgaaaaaaaaaatgcatgtatatatgattttggcggtgaattttgcagtacaaaagggcggccacactcctgctcgctgaagacggattctgtttcctcgacaattacaatcatcgtcagttcccagtactctggtgcacggtccggccctccctgcggacagatctagtacccgcactttaaagcgtggtccattatcactcacagcctccatacaacaatacaatatcatcgactgaagaagctattaaaaaaatatttatacttttttgagtgccttttctcaaagtctgtcacaaaaaaaacattaaatatatcaaatttttggagtttttcattattttgtcgtgagtttagccccctgtcagtgggtcctgactaactaaccatgtttccggggtataccctacctattctaggtactccgtagccatggctgatgttgtttccgcgtttcagtcttggtggggtgaccttgtcaggcagaatcccccaggatggatcgaagctttcggggtcactattctcgaagtggtgatttcgactgttgtcggagttttctgctacgccacctctcgcgacaaagggtatcgtgagatggtgcgcggctcagcgggtctggtttccttcaatctggttctgaggacattgtcccatattttgatgctgcagatctacgcttggctctgcggcgacggcgcttcgtggcagaacgtggcgtttactcgcgtctcggcggaggtgccctccgtccggaagcttctcacccagtttgcgctggcgatttgcatcttcgacgtgctcttttattcttggcatcggatgctgcattcgccgcgtctctatagaaagatccattctgttcatcacaccttcgagcatcgctcaaagcatcgggtgccgctggctgtgtattatgtgcatccgatcgagatgctccttctggagatgtcggtgcacctgtcgtgctcgctgcagggagctcatgtgttgacctatctcttctccggcacgatggcgctgctcatggcgttgtatggacattctggccgcgatttgtttgggttgatgagtcacgaacaccaccatgtgcgggagtcaaagaactatggagcgaccggaatgatggatttcctttggggcagttttgagtctcgtaaagctggtaaaggtgagtatttgaagcaagtatggtgcagagtgacatggtataatgtgaagtaggagcttgaaccgcccgtgctggttaacacagtacaacattctcgacttggagatcaacttgtgcctgcataggcccttacatgagagtcgagttgtgcctgaggaatgaggcaagttgaggcaggacagctaaaatgaatttataaaactggccttgatctcttgacaaagcgatcatactcatgactaacaggagtctgaagactgagacgatgaaggagatggaacctgatcgatagattcttgattctttctctatcatagtttatcactgtcattccttctgtcaacccgagctagctatcattcagattagggatgcactagataaccttggttattcttttgtagcccagtctgtttgactttgcttctgcctgcactctgtcacatgactgagaaaagtggccatgtgttggtgcctgacccatacggcattcaggcagctgccaggtctgaccaatcagctgtcagttaccacgtgaccgccaaaccggccacgcagatttagagccgacctcaacgccggctcctagtcagttcttctttttcttccccagagggagcaataatatattgatcttctatgcctagatagacttcatctatttccccactgagctctcggcagccttacgccgagaggttatgagcccggcagcactggcagacgactgataacgacgttgtctgacttacaattcgaatcgatcgacctgactggcaaggtgccggggtctcgctcccttgatcgactcgaatggacttgaatacagagtagattactctgaaaacgatcttacacacggatctggagctcagaacggcttcatacgttccatacagcttatatggctaacttgactcaattgaacgattaaaatgtcgactcattaatttttattaataataaactagtagtaattatatttttattattaatattatagtcttctaatatcataatttaaagggttttataaaaatatttataataccttctatatctataatatcctccttagaattaagtattaatgaagaactatagtccctttatttaattaattaatttttattaataataaaattattaaaaagcaaataaaaagtctatataaatcttatattaaaggtaaatatactatccttaaagaagctctaactattaccccctaactctctcttatatttctaaataaataaaaaactcctcctaattatatattataatatttattatcagtctttttgttttttaaataaaatttccctaattagccccttagagttattatagccttcttatattactataatcctataaggtccctatagaaccttaagtttacttaatctagtaacgtaatcggacaccgagctgccatgtcatccaccaccaccccctaatcaaatttgatgcaatttgtttttaatgcaccatgccatggctgatatatcaaaggaagggcgtatgcaattagcaattgaggcctataagaaaggtcttttctcatcaaaaaaggcagctgcagatgcatttgacatgccttgaaggacccttaagacgcaccttaatgggactacttcttgcaaagattcaatggcaaattgttgaaaattgacagatactgaagaaactatactttcaaaatagattcttgatatggaccgacatggcctacctctgcaaatttcgaccatatgctatctggcacagctattgctctctacacaattgtcctcagatgctactgccaccattggtgagaaatgggtgaaccaatttattaagcaccataatgagctttactctaaatatacctgaaagtatgattatcaatgagcaaaatgtaaagatccagagctcattaaggggtgattcaagcagtttcatgatactattcaaaagtatgggatccttgagcaagatatctacaacatggacgagactggcttccaaatgggtgtgatttcaactgccaaagttatctgtggatcagaaacacaggagagtcatgcaaaagctatacagcctaggaatcatgaatgagttactgcaattgttgcagtaaatgcagctggatgggccttacctccacatattagtaaatactgtataactagttagttaggaggatattgatcgagaactggtacgaagaaaatgctctctcttaggggttgtggatttgtatactgccaacgttacaggcggacgatactagaattcgacatctagtgataggtacaggcctgagctccttttcatactgagaaactcctcgaaagaaaagaaagagagactgattcaatgaatttctgattcaagaccttttcagatagttgaggtcatggcttgggcagaaccctaacacgccgacatggatcacgccttactcatcctagtaagattttcgtatcaggcccgagcaacaccattcaaggtaccagattccattcttcgtactactatactccgtagataacaagtgctcgccttcaaaaagttcttacactggagtgaccaaattctagctgcaactcatcgtcaaccaaagaatctgcctatcgaaatgactcagcaactccaaactccttgctcctgtgaccccccgcaacccaccttcctaatctggcaaatatagaattctaattcgacgctcaaagcctagttgaatatctccttgcattccggaatggtttgctcagaagtcgcctactttggtatgtgatcatggtctagatgggctatatagagcagctcttttcctaggtagttggacagttgaaccaggtgctcattctgagcaccattagtaagatctgaatcttccaatggattataacaacgcaattggtagttaatagtgccttcatgagccagctctccagctgcaatctttgctcaggcatccatcatagcattttcctaggagcttcaggagaaggcatggttttcgtcagtacgccgccattcacaagtttcaggacataatcttagatagacacaaaacagcagttccaacatttctggtaactttttaatgtgagtttagatttcttgctcgtcctaggaaacagtcctgcaggaggatcctaactagagtggcactatttctcaatcctacaccggtatggaccacgtggcattactgcgggtaataaggccaggtagcagctgcatactctgttggagaagttagaaggaccaaattacataccttgtgacataagaaggtactaaaaagcctgacatgcagacctgcctcgaaatgcactctcaaacctcctccgttcttgtcatttgtataaatcttgtactgtggatgtagcatagaagtaaccagatcgactgcatctgctttattgaacctgaattggacaaggaggcataggactgggaataggtcttttgattgtttcttggcaacagcattgtagatctgcacaaaggttataattgcgccgcggagtaaataatggacatgagctgaggcatgtcttaatggtcgtcttgtctagatggcagcattccagatcggtctttggtcacatgtccagcagtcactcgagcactattaaagcactccttctccctgccagatctccatcaacagttcacaacgaagcctcttcctcgttgcacttggatctgctgatcaggtgcacattctttcctcatcgattcgatcaaccctttactttctttccgcaacactgagcattccattgcattcagctcaatgctgaggctgttcttgctcagagtgggggggaaagaaactggttgagccacatgccagccaccctcatactccttcctgaaacagtatctctctatcggctgaattgctgctgtgcggcactcgagcaacaataataataataatgacaataaatcagatgagatcatccaagagtgacaagacagcttccacgttctctcgatcgccgatccgaggcatggcagttggcctgggcgctagatcgtgccgcgtgccgaaaagcttgatttagcctgaattgcccatggcaacgcacggctcctccccggagtatccccgacattctccagctttctccagctctccacatcgaggctgacccgtgcggatggcgatattgtcatctgcagaatggtcctcgctgccacgaggctgctcgcacggcttcattaggcacagtaacgactgagatggaccgtgacagcagcttgaagaagcttcatgttggcgcttttcccggttaaaactataaccacattcaactaatctccctagcaaagcacagagctctcaccgtccgcaacctgcatgccgctgtcccgtttccccacattatttccccgagccgacattcgacagtgacgcaacggcttaatgccatcgggagtggacgttgtcgataatggaccgtcaaagcgaataatgataatacccggccagtcggatagaggccgacggcatctttccatcatcgccttcccgacttcgccatggccgagctaataaaattgcagcccggaataacgtcactgttctcacctgcagtgagcaacatgaacgggttgccgggacgaattcaggctaaatgctgaaagaggaagtcggaaaacctgccggttgataggtgctcgagctctagaatccctctacgggggatcgcccattcgagcttctgtattcgggctcgcatggctgcggagctgtggggtttgctgatagctcggggatgcagagcacggcaattgggagaccgaccagagacagacggatgtattataaatactgcagccatggtcagagctcacgggggtttcctgcatcgattcggtgtcaaccatctcctgggcgagctccaaatcgaccatggtgactcgcgcggcgattctcaccgcagtggcggcgctcctgcccaccgcgacatgggcacaggataaccaaacctatgccaattactcgtcgcagtctcagccggacctgtttccccggaccgtcgcgaccatcgacctgtccttccccgactgtgagaatggcccgctcagcacgaacctggtgtgcaacaaatcggccgatccctgggcccgagctgaggccctcatctcgctctttaccctcgaagagctgattaacaacacccagaacaccgctcctggcgtgccccgtttgggtctgccccagtatcaggtgtggaatgaagctctgcacggactggaccgcgccaatttctcccattcgggcgaatacagctgggccacgtccttccccatgcccatcctgtcgatggcgtccttcaaccggaccctcatcaaccagattgcctccatcattgcaacgcaagcccgtgccttcaacaacgccggccgttacggccttgacagctatgcgcccaacatcaatggcttccgcagtcccctctggggccgtggacaggagacgcctggtgaggatgcgttcttcttgagttccacctatgcgtacgagtacatcacaggcctgcagggcggtgtcgacccagagcatgtcaagatcgtcgcgacggcgaagcacttcgccggctatgatctggagaactggggcaacgtctctcggctggggttcaatgctatcatcacgcagcaggatctctccgagtactacacccctcagttcctggcgtctgctcgatacgccaagacgcgcagcatcatgtgctcctacaatgcagtgaatggagtcccaagctgtgccaactccttcttcctccagacgcttctccgagaaaactttgacttcgttgacgacgggtacgtctcgtcggattgcgacgccgtctacaacgtcttcaacccacacggttacgcccttaaccagtcgggagccgctgcggactcgctcctagcaggtaccgatatcgactgtggtcagaccttgccgtggcacctgaatgagtccttcgtagaaggatacgtctcccgcggtgatatcgagaaatccctcacccgtctctactcaaacctggtgcgtctcggctactttgacggcaacaacagcgagtaccgcaacctcaactggaacgacgtcgtgactacggacgcctggaacatctcgtacgaggccgcggtggaaggtatcaccctgctcaagaacgacggaacgctgccgctgtccaagaaggtccgcagcattgcgctcatcggtccttgggccaatgccacggtgcagatgcagggtaactactatggaacgccaccgtatctgatcagtccgctggaagccgccaaggccagtgggttcacggtcaactatgcattcggtaccaacatctcgaccgattctacccagtggttcgcggaagccatcgcggcggcgaagaagtcggacgtgatcatctacgccggtggtattgacaacacgatcgaggcagagggacaggaccgcacggatctcaagtggccggggaaccagctggatctgatcgagcagctcagccaggtgggcaagcccttggtcgtcctgcagatgggcggtggccaggtggattcgtcgtcactcaaggccaacaagaatgtcaacgctctggtgtggggtggctatcccggacagtcgggtggtgcggccctgtttgacatccttacgggcaagcgtgcgccggccggtcgtctggtgagcacgcagtacccggccgagtatgcgacgcagttcccggccaacgacatgaacctgcgtccgaacggcagcaacccgggacagacatacatctggtacacgggcacgcccgtgtatgagttcggccacggtctgttctacacggagttccaggagtcggctgcggcgggcacgaacaagacgtcgactttcgacattctggaccttttctccacccctcatccgggatacgagtacatcgagcaggttccgttcatcaacgtgactgtggacgtgaagaacgtcggccacacgccatcgccgtacacgggtctgttgttcgcgaacacgacagccgggcccaagccgtacccgaacaaatggctcgtcgggttcgaccggctgccgacgatccagccgggcgagactgccaagttgacgatcccggtgccgttgggcgcgattgcgcgggcggacgagaacggcaacaaggtggtcttcccgggcaactacgaattggcactgaacaatgagcgatcggtagtggtgtcgttcacgctgacgggcgatgcggcgactctagagaaatggcctttgtgggagcaggcggtgccgggggtgacccagcagtagtacctagatgcgaatatgtatacacgactataaatactcgactatagatttagtgaattattttgaaataatgtatcaacggagtatctaatccacaatgggagggaagcatgacttacggttgatgactgaaatatccatattagaccaaattctatttccaagaaatttaatttccaagtgtaactgaataccccagccagaatatcatcttatcccaagaactcactcactcagtcagtaagtcatagataaatccaaccctccccactgttagttagcatcaaagtccagccaggaacggattgctgaactccaactagacggccccagtcccagtcccagtcccagtcccagaaggagggcaacgagccaaaatcgggggccccagcgatagagatgtatgtacgtatcgcaagtgaggaaggagaactgcaaattcacctccttttctttctttctttcaagatggcaggcaggcaaggtgactgactgactgactgactgagtgctctggacgagatttatgccaagtggcagaggtatacacagtacagtactgtacattacattattgcgtgtggtgacagatattgactgatacgctttttatttactttttaccgtttgggttacttaaagggagttaagttagttacataccttgcataccaaccagctcacacagtctgactagctctgactagctggagatagcttatagtaagttcagtcagtcaaagcagtgagatagatagatagatagatagatagattctgaataaaagggaacgaaacagcagctagatttccattacatgtacgatgtacctggccactgctagatactagacttataaatcattccatcgataagagggggtgaaaaaaaaaagagagagagagagagagagagaagagagaagaagaagaagaagaagaagaagatgatgatgatgatgatgaagatgatgatgaagatgatgcaatcatagatcgatcaccttcgatcaaatatttctaggttgtaacactttcatttctgcttcacaggaacgtttactctaatagtctaattataatactatattattattaaacatcttggatcagatcaaagagcttagttggaagatctcaataaataaatatcaataaactacctaggtagtcacagacattccttagtgtgataaaaaggacggtccacagagatagaccttccacacgtgaattgttagggtggaggatccgactacataaacaagtaggtaagtatccaagtttattgtccagatgtatcttgagagcagtgagacatgcccaggacacagaagtctagcatgggtagtgctgttattatatatatacagggcaagtaagaccataattttatgcctgttctaagctagtactgtatataactatcactaatatataaaatagcccctaggggaaaaacaccccccaaacaaaaccctctagaaggtcctatctatattactaggtatagagtatacaacaaagggacatagtataaataagaactatgctttataacttcccctaccttttctgtatactgggtgcacactaaaccagaacccccctcttctactatggttgatataaactagttgcaggatttaataaacctgtattaagcttcttgttatgttatagttgtgggcttggccccaatcttaagccagacaactttttgtagctcacccagtaccctaggtggttaccactcaaccgcccgctggctccgactacgtaaacactccttaaggtatggccgtcgatatcgctgcacgcgacaggggagaagataatctttaggaatatgggtttaccaaatatgtatcctaaatcgtagatcatgaaatgaaataaattgatcgctagtatggtttactaatatctatccagatatcctgatcaggaacatcagcaggatatataattaaaactaattttcagtgttttttttttttgcatattgtccctgttttcgtaaatagtatcatttatgcaatgcaaacaataaatagacttctagatagatatatagttagaaagaaaatccgcctcaagaactcaagtgtagatcgatccattgttggacggtattggtacaaatggtccatacagagtagttacttggactgcatggtcactccatccttactaataaagggtcagggtcacatagatgatcgatccattagtgagtgtatggcaataatcacgtgttaaggatcatccatgcatgtcatgtacctgtacataaatacagtacataggataagtttatggggctctcttgattgaccttggtcaagcatctcccttagttaatggatatggcattgagtagatgagtagatgaggaggtctgcgcaaacggtctgagatgagtcagatgactgactatagaacttgtagtaatgacatgaagaaggacgacgattgttattattactattaataggaaagaacgggaagaggatgatgatgatgaggaaacaggactgattttatacgcataattataaaaaaaaaagaaaaagaaaaagaaagaaaaactctagaatagaaacaataatcttccatctcctcgagtcagccttttttttgagtggaatggaatggaatggataccggctgactttctttttgattcaaatcacaggtgagaatcctaccccctaagtaagacttgacaatatatttaattagataattaggttgagagccatatcacatgccatgtcacgcctaagatatagaagaaaagtccttggcatggcacggagtagttttttttttaagtcattctagttcagcaaagcgagtcctctaagggttatatctaataaaagcaaaccaaaaataaaagaaagtagctagttcgcagtctaacaaaaagtcacaatttatgtttatttattttttttgaacccttcaaaaaggggtaatacacagtaattaattattaattaattaattaatttgtttgtttgaaaccaggggattattactatcagtctctctttttctctctccccaccatccctctcaattacttttttgtttgcaatttgtatctagtgtaattcagtatcttatctatctatctatattcatctctaaattccatgctttcaattccatgaatgaatgacttggaagactgtatattacctttttttatttgtctcttttcgaagtatttataattctatatttatatataaatccacctcgactgatcatgacctttatactctgatatatatataatagagcacatgaaacgaattctatgaattctatatatattcccagattggtgcccaactatcctaacaaactaacaaggagcaacaacaaccttatttatacagtatatagcatgtatcatggacacaaacaggggttgatttacctccctcctagatccgtcttctgtatgtacagtacagtacgtccatatgtatgtatgtatgtatgtctatccagcagataatacccatccatccaacccacacaaaccttccagctagaggagggagggactatctatcgccatcatcatcagatatatatatatatacccccttactcctcaacacaacaaccacagcagaccttgatccttgatctagtaataagcaaaccgatactccggcttcccactcgacgccctcctccccttcttctccttggacctcgaactcgccaacctcttgctcgccgaccccgaactcctacccctatccctactccgcgaacgggacgtgctcggtttccgtctcgcctggccctgctgcgcgcgaaaagagcgggttctgttctttctcccaccgtcgcctttgtgctccacgcgcgtgtgcgggtcgtcgcgcgagcggtcttcgtccgaggagtcttcgtgcaggacgttgcggaaggtgtcttcgcggggttggttgaagtctcctggtgtttgggtgagtggggactggtctctgagggctttgttgggtttgttgggcatgttgtgttgtcgtcgttcgtcgtcgatgtggtttaaactgaactggttgaagtgaacaggttgacgggttgaggttgagagaaaggttttttttttctctcgttcgctttcggtatggtatggtcctcctgtaaataaataaattgtattgttggtgttgatgttggaggacttcgtttccctttttttcaaggaggtaatatagacagatagataggtacagatacagggtataggtacaggtatagctatagtatagggaggtagaaaatgtaatcagctagagtagtaacctacgctcgaggacggccgtaaccatgtcgtcatcatggcaagttatgtaaggcgaggcgacgagcgccaccgtctgccacgggaaagtctggtatccacggacatgataagatcgaagtgggtaggtgtcagtgattggatgtaaacgtttgtacctaggtgtctaccaagcagattgaccattgaatagttcggacctcagacctctttattcctgcacatagatatcttctgattgcatacatgacaaacccaaccaagacggcctagtggaagccagcaagaaagaagaagctcggggaatcaaccagacggccatgtaaaactcaattttacacctgcccggccatcctgatatcaatagcgaaacgattaacgatggcaagacgaaaaacggtcgtatcagtgtcagtttacatccaccccgcactctgcctaccgggctctagcagaattccagacactcgacgcagtcgaggcagcactcgcacgtctcctcacagaggaagcagcagcacatggtcgcaaggctggtaacactcgtcagcggcgatcgcatacgacagtccatcaatggagacaaaccaggcacccaggcatcctcggtccgtgctctgtttcggctggggaggcggaggctgctggtattgcatctgctgctggttagccagttaactagtcagaggggttcagagtcataggaataacacgacataccggagggtaaccctgtggaggagcataaccctgctgcggggggtagccctggggcggcggaggcccgtatctacgcgttcaatctctcagcaacatgtcacccaaaagacaaaatttcgaaagaaaaatttcgaaagcgcactggctgcatcgcacaatgcgctggctcgggcatcgtccgtggccgtcgcttcatccttgcgcatcgcacgagagcagcgacagggattgcatgccagggagacgagtcggggacatacgtctgaggaggatactgaggctgctggttgtagtaggcctggttcgacatgatggcggtcgctcgtagtctgcgcgaggatattatcagttcgccgtccgccgagacaagcacgaaaacaaggacagacagacgcacctgaaaaagacgggtcaagctgcgatggaagacagcaagagacgggatagcagaagacagaaaatcgactgtgggcgacagctgacgtcgtatggcggagcggagagtgaaaagggaagagaggtgtgagacacggggaagcggaggcaggctagagcaggagcagcgcaggatgggccagtcacgggcagcagccaagtgggacgataggccacgcgggtccgagttagttgccaatcttgacgatggcaatcaaaagaatcacggccagcagcgacgatgatgatccggagatgaggcgccttttgtatcgcgcgcgtttcaaatcgctcgtccggcgattcctggcgaaggcgcaggcgaggaacagcctgcctcagttactccgtaaaggagcactgccagcctggcgaatcgctcccgcaggaagagagcgtcgcgccagcccggccatgccaagccagcccagccggccccagctggccagccctactgcgagtctagcctctagccggtggttcgactgctctgttggtaccgttgttgatctaggatgcccgtttgtctcccgctggcaccccagctacgaattacggcacagccggcagagtcgcaatcctcctctcgtcagctgtacagtccatctgcagctgcaggggcagcatccctggccgttgggactcttgaccgcagaccgccagatgccagccagcaaactttcagtagcgtgtcgcctggtggagacgttggcagcagctctacagtttccaccagccagctcgagtatgaacggtgcacggtcccgtgcatcgccctctgtggcacagccaatgcacgtgatgcctcgactatgctccagccacgcagccacgtcagacgcggccacctacgtaagtcgacaaggttcttgtacgagggagcagattgtggctgtgactcattcttcattaggtcagagaacagactagaaataagtatatacagcgaacaaaagggaaaagggggaaaatattacaaataacacaagataatcaagaacacgacaaaaatacgagagaagaaagaagaagagaaaagcaaaaataaaagaaataaagatacacatctgaccatcacacattaatcgtaacacatgctgaatcatctgcctccatccagggaagacagtgcagaacaccatgctcaatactcatcaccctcgcagaacacaagcaagaaacaaatatgaacaggtcaaaaatgaacaaggataaaaggacaagaaaaaaaaacccatccagaaagcaggtcagtttacagtcagttatcagtcagttcagtcagttatacagcagttttcacaaggtacggatctgcctccgcagacagctgctgcgactcgaggcagaaagacgggtcaaatgacggattattcaggtccgtcagcggttgcgggaatgcttcatacccttgaccagccatagccggatcccactccagcgacgtcgaagcgtcatactccagtcccatctctgggttcatctcaggtcccttcgcaggcgacccagaaggcgcctgcgtctgcgcctgcgtctgcgcctgcacctgtgcctgagcctgagcttgagcctgcgcctgagcctgcgcctgagcctgcgcttgggcctgcgcttgtgcctgctgaatagcggcagcggccacatcggcgggaatctcctcgtcgagaaggtactgcgcattttccagcacgagctcttccttctgctccatccagtgcttcagtacctccatcggcgggtgattcccgccgcctttgccgccccgcttctcgctatccttgccccgtccgccgcgtccacgctggcacgggttgaaatgcgtccgacgcaagtgcgcggccgcgttgtagttcgccccgtagcgcttgccgctgcggcaggccttgcagttggccaggaaggtcttgtccggcgagatatcgacacagacccagaccttgcgcaccaccgagtgcacccgctcgatgtgccggcgcagctcatgctcgccatggaagccctcgggctggtcctgacacaggtggcagtacgtcttctgacgcggcggacgctggaagttcgccttgggaatggccgccacctctttcgaggtgccattctccgacgagatccgaatcatctgatgttgctgatcactggacttagcagtggatgatgatgatgatgatgagctagacttgttagaaggcagcttcggtgcaatgggccgggccccctgcaccacttgttctgaagttcggcgtgcagtcctcgactgctgtgacagagacacagacgagctggtgctccctgtagacagagaatgcttcatctccacaccggcagatgaaggtgacagcgaaacagaattggcacggggcataaaagagccgggggttggggcggagctagaaaaggaaacagatgcgacgtcagataaggagaacggaagctgatcgatgttccgatcaagaggggaaagataggaggaagattgaaaagaaacgtcctgggcggacggttgctgcagaaagtcaggggatgaaaatggaacatcgaaattgtgctccaggttcgaccccgtcgagtcgaatcggaccattcccaatcctccacagattgaatccgtcgtcgtactacgactcatttcggttgctgccgccgtcgtgaccgtcagttggtcggacactggggaacctgacagccccgtcaaatcggccggctgtgctggtggttgcggcatctgcatctgcatctgcatctgcaactgctgttgctcctgtttgttgtcatgtaaccccctcgacgtggactcgtcgggggaatatgacaatgcaaaggcagaggtaccttgattgggaaagtcatccaaacactgctgcgtgtactcggacggcgagtattcgttgacgtcgtcgaggcgaagctggtacgaggtgggcccagatgactgccgtcgcagtgatgttgccgccgccgccgccgccgccaactgttgccggtgagaggccggattctgcaggctctgcgagcgggccatgggggccgatcgagagaaagatccattgtggccgctgagcgtggaatggatgccagtccgagagctggatgactgccgccgggtcatctgggaggccacagccgtggaggagtcaagggacgatggtgtaccagtccacttgaaggtgccggcaccgtcggactccggagtctgccaactgtcaatccagggaagcgatggggaaagagaaggggcgaggagcaggagcgggcaggaaacggatggacagaaaagaaggcgcacgtgaagggccaaggagacatacggtggcacgtcgtttcgccggcgagggtgctccaggaatcgtccggggaacatcctgtcgagtccgtttacccaaattgtccgaggaggatccgctgttggcggtagtagtagtagtagtcatagtggtggcggtagtgccagttgtgtcgcctggggccgtggaggagccgtcgcgggtggaggacggtgtcatgaactgactgagtcgttgggtccaaagttgatttcgctccgactctgggaggtgggcatgctgaaccaaaaagtagtcccggaagctggaaatggccctcgtaaataactcgtcatcggccgtagagacagccatgatgccgggaagttcctctccctcgtaaggtacgtggcaggagctaggatcagtagtatcagacacggggatgagcacaaggtgggatctctctgggagctctggtcagtatgagtcagagcacagcgagaaggtcccgactcacagacaacagaagggatcaatgggagacgggtgtatgatgaggatgcaggtcgaacggatgagtgtggtgatggtcggtataaggaagacaaggttcacgaggatagtagatgtcgctctggatgtgatgggaagactggagtgaagaagataacgatcgaagaacctggggatcgctgataataagaaaacggccaagaacaggagcaggggaagcttcaacctcacgtgtctggcgatccatcgcagttggtcagggcccgtctcggacaccacggtcagactcagtcctacagagcggagaacacactgggggagaggggatgttctagacgagcgcttccgtcgtggctcggaagaccggtcaggcgcagcagagtcgaagaggcccgaaacagctaggtggctcagcgtagggtagaccctgcaggccaaccagcgagggaccgggacgatgagggcgcgtggatggagagagttcgacggagggccgctgggtcgtgcagcagagaagtgaggcagcgaaacggatcgtgctggcagaagccgggccagcgagaggcggcgctgcgcaccccgctagcagcccttagcagttagcagacgcagccgctgttaacgagagtgcccactaaacttaggcgtgcccgcgaccctccctcccccgaagcagcccccgagggcgccgtcgccggcgtgctgaccccccccagagccctcccgacgggggtcctccagcaggcctgagtcctggggcatgctgcctggcacctctcgagtccctggcggccacgttgttgcacgagtcagccctcgcccttgccaacacgagtcggctccctgccaagcagctgtctggcactctgcggtctcgcctgccccatcgcggccgggcgtatcagcagcgctgcccacgtaagaaaccaatccacgctcgcctccagcttatgcacgaacttggtcactgatccattgctgtttggctggccgtgtgtcctgccatgacggagcatcgctgcctacgcggactaagacctgcgttgcgcgaccagatcggtttcgatctcctctcctgcaaatcacagcgatgcgctggggcagtcccttggccggcgctgtactaagaataatgccaatgccatacgatgatcccatcgtgggcccggtccgaccgtcttccggatgatggaggaactcacgcacgtcatattctggtggcggtccgtcgctgtttttcctcctcgagagactgtagaccgtcactgcaccgtgtccacatggccaggctattcaggaaccgtcgaatccctccgtatccactgtctggtctgtggaggatggcgagggcagtttctgggcgttgcgctggaggcagatctccgtgagtcacggaactgggcggccgagcggtgagatgtccgatcctgagaccacggggtaaggaactagttgccagcgcggtctccgcgatttgcgtcggtgaaaaatgatcttcgtggtctggatcccgattcctcaactcaccaagtcacctggatcgtcatggtcagagggtatgcgtttggtggtgctttgcgcgatgattcaatgattattgcttagagaggggacgggagcgaactatgatgccttccgactgcgttcaagtgctcaacctgaaacaacgtccaccgttgacgttgtcgcctccaactcgaaagaaatggacacatttacctccataattactttcatagagtcaaaagctgttacgaccctgcaaaacccgtttcctcgcagtcattgccgtcatatccttggtacctctctggtcggttccaaggaatgccaatccgaaaatgtggtaactgcaacggcaagtggatctttgctcctcaactttgcgccagtggcttttttggagactgatccacaatctattgaatgatggactactcgtatagattcgcagtagtttgcctagacggacggactacgagcaggagggaccttgcgggagtcaccggaggtcatagttagtcttcgctgctgacatcagactgctcacaagttacggagtgctccggacaacaagtcgagaaacacctggcaatcgcttgaaacgagccatgacagggtcaggaactcgtcgggaactcctgcaaggacagccaccctgggcaatctgcctctaccgggaaattgtacacgtttcgaacttgctgactcaccaacacaatcggatcattgtagccatgtctgaacgagactaggagagagatcacctcaatcatgaccactgtaccattgacaccataatctgcaaggtgtgatggcatccaaacgacctcgttataaagccgctaatgccgcccgaattccagcacagcccctgtgcaaccgtcaaaagcgaggggatgctgagtacatggctgttgctcttgctgccagcagaccgggatgcctgcagattcaggctgccgaagcgtcaggcacccaggccgccaggcagtgaggctgcttatatctggcacaccgcattggctccgatcccgcctatcacatccacgctttccagcggctgtcttcatccagatgaatccttgctttccataagtcaatcaggtataatggtgagttcactgataagcaggtatgcggctcggcagtgacagcacaccgttcttcgagcctgtgtcactatatcctggtcgcagctcccatccattgatggacagtgatctgaaccgtggtatcaccagctggacacagtcgaagctagtggctatttgttgttcttgcaggtgtagctgccattgccacgacttgagattagttttagttaatcccaaggagcaatttctcattttcactatatgattttagtttggacttatttgtcttttattcctgtcttctttccaggctgtcttctgtcattctctgccgtattctttaccattatcatgatactctgtaccaaagtaagcttgggcagttatgtaacaaggttaggttccaaggcaagacagcttggcagacaactgcttgtttatatattacagaaaccacacaaaatgcccgcgtgtctgtcattctgataaatttcagatggaataaattaatatattattctgcatgtctggatgagagagaagataataagaatgatgagcatcgtgaagcatcagttaatgccatctacctggtcagcggtgtggtttgctggtacattgacgtcagccagcttgcctccacagacaaccaagaaaccccgcgacacagagagccaccgcaacagcgaccacaacaattatcctcaaaatagtttccctttctgttttaatttaaatagtctatactacagacattcctctcattttttttaagattgaaaacttaaagattttgaaccagactgagctctggagctccctggggtgcccatccagatcatcagggagggggaattctccacacacgtgatttggctcatattgcttgttcaaaacagtcacggtcgcacattcacattcacagtcccaacttccaactattatttcaggccagcttcagggtcgatcgctggttttctttcttgtggaggccgcagtccacgtctgtccttgtagaaatctcataacaaccttcctccccctcttcatcgcagcagccacatcgccaacatggcggactctgcgccccaatccacggccgatggcaccctgtacctctacacctccctcaccgcaggctcctcccacattatcactgccacctcgcgactcgagaccatcctgaaagcgaacaagatccctttccgcgcgattgatgtggccacggacgagaaagcccgcatgctatggggccgccgatccaaaggcagaaagcttccgggtctggtcaaatacggcaatgtcgtaggcgtaagtttgtctgccggcaatcaccacatctcccctgtcatatggggcctgtacatctttgtcgaagactgatttgattgattacgataggacttggaacaaatcgaagagtggaacgaatacggcgaactcaagcagcaaatcgagtccatcacgcacctagatgctctccccgaaccccgcgtgaacacccctgccaacacgtcggccaagcctcctacccctgcagagtctccagctccagctccagccaccccgaagccgacgagtagctcgccacatatccagatccagactcctcccagcaagaacgacgtgaaggatgaccacattgcgctggcactgcggcaggccggcgaggaggccgcgtccaaggcgaaggaaaatgcccgtgcgaaactaggaaccaagcctcccagcaaggagggagacggcaaactgccgcccacgtcgaagcccgaagcgaaagccaccgagcccgtcgggaaagtggatgcgaaggatgtcgagggccgacagccgggggtgccggtctcagatgcagaccaaggacaacaccgacaatcagtcgcgcccgctccggaaattgtcgctcctccccagagaccatcgttggaaagcgagtgcgctgccgtctcgagtgccaacttccgcgccgagaacgccgagacgctgggtctcgtgggacatcatcgcgggtctattgtctctgcgacgtcgaaggaggaaaaggaccaggtggctcgcgatctgcgcgactcagtctcgcagccagtcgccgatggggatcttcaagagttgcgaagctcagcgaacaaggggcaggaggagacggtcgaggatgaagaagaagaagaaggcgaaggcaaggctgacgaggagaagaaagacacggatggccacaaggtctcaggagaggagactagtcctagcccacagcagcaggatcccaaggccggagagcaggctggtatcagtgtgaaagactaagggtgtcttcccttctcttgcacaccacagcacgacaaacgtcatttgttttgcggtattagcacaacgatcagttcttgtttctgtttatggctgttcatgttcctgcttcattacggtcgtacatactcatgctacttacatgtttgttacgaagtgaatgaccagttgaatgtgataccattcttttgattgtcttgcacaggaagtatgatttccaagccacatacttgtcttatcccggaatggtattagattgcactgcatgcgctggtggtaatttattcataccgattacttaacattatctacggtaaacaacgtcatataggtatctaaagcaaataatcaggtccgtaacggacttattttttcttttactctttttcttgcttttcttttaacgccgccgcttctcaacagcctctctcagtttcgcaatcacatctgccggatccttggctccaaacacggccgacccagccacgatgacattggcgcctgcatccgcagcctggtcgatcgtgcccaggcccagcccgccatctacctcgatgttcaggtctggatagcgctcgcggagcgccttcaccttgggcagctctgagggcatgaacttttgcccgccgaaaccgggctcgacggtcatgacgagaaccatctatttttggacaagagaaagaaaacattcgttagcctgtttgttttttttttctcgggtgaaattggggctgtcgggcttggggctactcacatccggtcgctcaatctcctccttgctctcgagaatgtcccacaggacgtcgacggaggtgctgggcttgatggcgatgcctgccttcatcccctcctcgcttgaaggtgctgaagggcagcaaaaagctcaagagcatgagcaactgcaggaatcatctcgacgaccacggagaccaccaaggtgcagtaattgcaatcaagaaggccataatcggcttaaatgtcctaataaatagtgccttttgttttatataggaaaatataatagattttgttgcaataatcttcaagattttcggtcacgttgggctgcaactcttggccaaggactgaccagctcggtggtgtgaccagctcggtggtggattacgttagtcttcctcgctgaccaaggccaaaaaaggcagtctaaaaatggctggccgggtggagtagctgttagtatgttgttgagtttttgctcggaaccgaagcgtggccctcgttgcccaaaatggacggacggcgccaagacttcgcttaggtcagcccacaactcgttaagcgtgcaaaatacacttccgacaattttggagatccgacactctcaccacctcgacgactactaacgacaacagggtcaagatgtaagtgaaccagcctcaatggcatgtcttttccatcgcggatgtgatatctgactttgttcttccatgcaggagtcaccggaagtacgaagcgcctcggcacggttcgtcatcctcagcgatactcctgaaacttgcttgaaattcggtcgttttttgtgtgcggttgactgattgccatctctacaggctctcttgccttcctgccgcgcaagcgggcctcgagacaccgtggaaaggtcaagaggttagtcaatcgactttcctgccatcgatgttgaaggtcgcgttatactgagaatctcttcgcaacagcttccccaaggatgaccccaagaagcccgtccacctgacggccgccatgggctacaaggccggtatgaccaccatcgtccgtgaccttgaccgtcccggtgccaagatgcacaagaaggagatcgtcgaggccgtcaccgtcattgagactcctccggtatgcgaaagcaagcttctctcgtgtatttgtggctcggatcgctgacatccttttagatgatcgcggttggtgtcgtcggctacattgagacccctcgtggtctccgctcgctcaccactgtctgggctgagcacctgagcgacgaggtcaagaggcgcttctacaagaactggtacaagagcaagaagaaggccttcaccaagtacgccaagaagcacgctgagcagggcggtgctcccatcacccgcgagctggagcgcatcaagaagtactgcactgtcgtccgtctgcttgctcacacccagatccgcaagaccccgctcaagcagaagaaggcccacttgatggagatccagatcaacggtggcactgtcgccgagaaggtcgacttcgcccacaacctcttcgagaaggaaatccccatcgacaccatcttcgagcaggacgagatgatcgatgtcatcgccgttaccaagggtcacggtttcaacggtgttactgcccgttggggcaccaagaagctgcctcgcaagactcacaagggtctccgcaaggttgcttgtatcggtgcctggcacccgaaccacgtccagtggactgttgcccgtgctggtcagttgggttaccaccaccgcacctcgatcaaccacaagatctaccgtatcggcaagggttcggacgagggcaacgcttcgaccgactacgatatctccaagaagcagatcactccgtacgtgctatttctgtccatttatcgcttatgggtactaaccaatatccagtatgggtggttttgtccgctatggtgaggtcaagaatgacttcatcctccttaagggttccgttcctggtgtgaagaagcgggtcatgactctgcgcaagtctctctgcccgcagaccagccggaaagccaccgagaaggtcgagctcaaatggatcgacacctcctccaagttcggtcacggtgccttccagacgccggccgagaagcgtgccttcatgggtacgctcaagaaggatctcgttaccactgtttaatttgttccttcttctggtggagatattgggtcggtgtagtgcgatgcatgattttccttgattaaaacgaatcaaaataccttgttcttgcaagcctgtcgcctggcgtaaaaaatgaattgaaaagcaaatggcgtaccagttctgagtttattagattatgtagctggtaaagcgatttcatgacggacaaaagaaaagatctgatagtatccgcttgctctgtagtagtagtcgtactgttagtgttgtagttggtcttatctggatccgtcgcagtccaggattttaaatctgtaactaggtaaaaaaaaaattagaacttccaattctccaccaattcttctgccccttctcatcactagcaatcgacttggaccgcaatcctcgtttttcgcaggccgagggatcgttgcgggccagagtgctgctgacccattgcgtcatgcacgatttccggcttctcacccccgcgatcaggcacacaaagtacgtgcatgcgcggataacatcgctgccggcatcaccgcacctccgaggcagtcccttgcatcattcccgctctttgcaccctagcaggacatctcaaagaactgacaatctccccgcgactgcaccaatcgcgcagacacggcccttttccgccgcgacgagaagaaacatggcttccgatgcggactacatggccttcctggacaaggccaacgcccagcgcgaggcgggcctgcgcaatcggtcccagacgcagccgtcaacgagtatcaggaccgagaccgtcgagaccggggtgagggtccccgatgtgctgaagctggtggacacgtattacgtctcggagacagacgagccgtttgagccggtctcgttgaggtgggagggtgctgtgagaggggtatggccgggggctggtaagttgacatctaaccataatcactgctaatagactcttcaatgaattacgcctgactgaaacgaaaaaaaaaagagcaattcgcatccctcatcaccggctctccctccgccacatcagatctcttcgactccgggtccatctcgacgctttcgcccgatgcctgggatcccaaaggccagtacaccgctgtgctccgtgccgtccgcaccgctgccgtggcctcggatgcgtcgacgagcaatgtcgaccaggccggtgtcgacgtcaaggtctaccgggtggaggtgggcagaagtcgggtggaatactgggttctggcgctggacgttgtggaggggaggattgttgggttgagggcgaaggctgttgagacttgatcttgaaaaaaaaaatctgtgtttgctgatgccattttttatttgttctgttctgttctgtactgtttcattgggatggatgactgtactactgtacaaaaaataaaacatgcgacgaaagggttggagggtgttgaagagtgtaattcttcggatatagatactggtatactgtcactgtcctctacctagatgtgtaattgcatttctcttattctaagtgccatttaaatccaacctatacgtgcggtgcaggcttcgtgaacaggacgagtgcattctggcttcaattttacatattttcatcaaatcaccagtgtaagaggtaattaaacaaatctacctccaatgtacccaacaaaatatatctgtgacaacatactataagaagtgtcccatctgcagtgtcatcttcaatatctgtcaatcaactcaatccctgtgtcggattgcaccgttctaagcttcttcattgctcgattcaaggttccgtccccatggggtcataaggctaaccacaggaaatctcagcatctctctgataacactgttattaatattttttcagacacagaacaccagatgagctgcattaaaaagagtgagcaatttctctgcactctgcacgcactgattgttgaggcatttgataaccgctgataagcggggcggcttgaaccccgacgatcctcctccgatcggagcgatgagtcatgtgagctgcaccgcgattcgagcttttgggagagatttttttaaacgcctccccaacaagaccgagtccaccgctagattcgatctttcctgcaccctttctctcttcctgattctctcaattgacctcatctagaccttttctcacctcccatttttgagttcccttcacacgtccaccatggccaaggataaggtctgtctgggtaagcgctctccccgcaattcgtacggcaatgctctcgtgctgaccgaaccactctgcagcgtactctggaggtttggacacctctgtcattctcgcatggctcattgagcagggctacgacgtcgtctgcttcttggtatgactcaatcgcgtatcgtatccgtcaattgacctggttctaacattctctttcttcctctcttccaggccgatgtcggccagaacgaggactggaaagccgccgaggagaaagccctcaagatcggtgcgaccaaattcgtcgtcgaggacctgaagcgcgaatttgtcgaggagctctgctggcgcgctgtccagtgcaacgccatcctggaagaccgctacctgctcggcacgtcgctcgctcggccggttattgcccgcgcccagatgcgcgttgctcagcgtgagggttgtgttgcggtcagccatggttgcacgggtaagggtaacgaccaagtccgtttcgagttggctttctatgccattcaggtatgctgccgcagctgtaagtttatcgggagaatctgtcgctcatgttcatgcgctgtagccttcgatcaaggtgattgctccttggcgcatgcccgaattcttcaaccgtttcgctggtcggaacgatctgttggactatgctgccaaggtcggcatccccgttacctctaccaaggcgtgagttacaccaagccaccttgtgttgccgatcaggtggagctgacaattgtgtagcaagccttggagtattgatgccaacttggctcataccagctatgaggcaggaattctggtaggctgaactatgcgaatatgatttggaattcgtcgctcacaaattttacaggaggaccccaatcagactcctccggatgacatgtggaggatgaccgactctccccttaacgcacccaacacccccgaggactttgctatctctttcgagaagggcttgcctgtcaagctgacgcttgcctctggcgagacgctgactgactcgcttgatattttcacgactttgaacgccattggccgaaagcacggcattggccgtatcgacattgtcgagaaccgttacatcggcatcaagagccgaggatgctacgactctcccgccatgaccatcctgcgggccgcccacatcgacctggagggtctggtgctggaccgtgaggtgcgcgcgctgcgcgaccagttcgtcacgttcaactggtccaagctggtttacaacgggctgtacttctccccggagcgggagttcatcgagaagagcgtgatcgccagccaggagacggtgaacggcacggtccggctgcgcgcctacaagggctctgtcagcatcctgggccgcttcagcgagacggagaagctgtacagcgccgaggagagcagcatggacagcctggtggactttagtcctgttgacacgaccggtttcattggcatctccaagatccgtctcgcaaagtacggccagaggaaggccgagatgggtgagagcctgagcagggcgtaagctgacatgtacatggcgacctttttttgtttcatatttctcgtattatttgtttttacaagcaaggcgtttttaaacctaggaaggaaatgaaagaatggaggagagaggggtctcgtctcgttatgatgtgtctgagagaaaaaaaaaagaaagaacaatgtagcgattgctttgaaatggagatcttaaataaaaacaattactgatttatctatattgctgtggtacagagtgcatatgtatatgcataggctggctgtaccagtatttccgtgttcaaacataatcaccattcaccaatagttaatgacaaggtattagataattcgatagctaatcttgatttctttgaccgtggttggttggttgattgtcagctgcctgcctgtctaggtatgtttcaggctgaggactgagggcttagggcttgggctatgattgacgattgacaattgaagactgacaggacctaggtacatgtacaatgtacagtacatacatacagcttaatccagttctattgtccagagctgaaacaagttggaggattcactcatttacttattcattcccctccccttttttttttcggcagaagagagtagaactgctcaaatgggcagtacaagtatgtacatacatacagtaacaacagagggagatagagaaataatttcagcgagagtcagactaatttaattcatttgtgtagctgaaatcaaatcaaagaaaaaaaataaaatcatctgagagtacagtacaataacatatgtggaagagaattgcttggaggagaaaacggctaagaaaaagaaaaggaaaatatagctactggaaacgagaaaatttttttaagaaaaattatgaatgactgtatcctgggtctgggtctggtttgtttgacttcgactttgactttggtttctggtagatagatagatggattaatttaaataaacagggtataataggatacagatttctctctctttctctctctcgtttttttctatcgatacgagggagggagcgagggcattttattttatccaactcagctcagtaattacctgggaatataaatgtaatccctagatacatgtctaagcttgctcttgttcttgctgttgctcttgctttctgaacacattttccatatcagctgcccgacgatatggatgcagtttgtttgcagcagtcacgttcaagtttagtctaacaagaattgtctgcaaagactagaaatttgctggtagaccggtttttcgtttttttttggggggggggggggaatatgtatatacccacagtgcctgttctatatgtcatgagcagaatggtgatttactattaataatagctttgatctctctgcgtgcctacgcgccttgacttgacttgacttcttgagacattgtcgcggatgaactggagttttgatgatcgtttagcggctgttctggaaaaaaaaaaggaaaagatgctgcgatcgttcttacttagttagggttagtgcagtagatacatatgtacagtacagtacgtatgtatgtaattggatttttgtctaccacactacttcaaagctattcaaagccagagagagagagtattctgcaatagtaagtagtagtaagttttctaccgtttttagcagcttgctggggaatgaaatatgtgcttcgtgcgtagatagggttagcgactgctgctggtggtggtggaagaagtagcgaggaacgcatacacatggtaatatcagtttttgttttttcaacgagaagagctgaagctgtcgggtgaacaacaacagaagtctgctagtttttttttcaagctggaagatgtctgatctaaagagaaagaacatggcgatcgcacggaaaagactgcggaaaaatgggaatatgcctcatatctaaaagtctttttttttctataggcaatgaaataatatgaaaaggatgtggatggaagtttttgggcaaacacaagggtatgcgtctccggacacgctttgaaggcagtcaagtttctaattctgactgttcagttcagtgtctcatatcaaattgtgttttcatcgcactgcttgtatttactgtacgttcatcgaatgatcgctcaacattctccttgaagagtacatacgaggaaattagccagcgaatgaatcccgtcggtcttttgtaatagagaactctctctttgacagaaatgtggaaatgagaggagagatacattaattagaactatatttattgcgatattccggaatgggaatttcatcacaatgcgattcgatttttttttgactccgccaagggagtgttttactgtcctcaattgcaaactggatgctcacaattacaaaaaaaaagaaaaaaaaaggtgtggaagaggctcttccattccttgtggaggatattcaatagcaaatacaaattatacttagcagcttagcgtggtataaaagcttactaagtaagaaagtgagaagagtacatgtacagtgactgctggtggtataaatcttgtgtgaatctgtagaaagtcagtttcagaagatggaaaatcaagatcaattttccaagctatcatgcagaccagaatgcggcgtcagaccagagaggaagaaccaattctggacactggataccacagaatcatcaattccaagcatggcgtgacaccagcatgtattcacctaatttgatcctctatattcatggtatattttgagagtctcctagatagtttcctaaagcaagagcagaacttagttctctcttctactgcaagcatcgacagcaaggaaagactacttacattttctgatattcttcgcggctttatggcagtgttcttctcacagatgaagtgttggtggtctggttcagtgagcatcatgcttgatcgcggttggttatctgcggtgtccaagaaattgcagagtttgccttcaacagccaagtcaacgtgttgtacatgttattcttgacactctggacaagtgcaatgcaagggaagcagagaaggctcttgattcttttcacgccagaaagtcactcaacttggaaccggtcagatcaactttctatttatcaggcagaggactgatacttttcaaaatgctattttcagctgcaaatatttttttatctgacagttacgaacatcataatgacatcgagagatatgtttagtacgaagttcgagttaggccatatctcagatggtgtctacagtcacggctgctgcaaaggcatgtagctctcatatcttccaataatgcaggccgttcgtgatcaatttcctcatttggtaaaaatacagatatacctatcaggttgacatctccggtttccgccgtatttcatcgcgctgtgcctgcctgccattgcttggctggcggaccctagtcccaatcggacatttctgcgatggcggcatgggcggggccccgcggggtgacggaaaccaatagtggcaggaataatcataatcaccatcagaatcacaatcataatacagctattgataattggcatccgaattagtgtataatgacaacaatttctctatttaatcgcttgcttctatcggaaggagtcctattgcaatttcgattttggagcagtcagtttgagtaaagtcggcgtacagtccgatatcggcactttccccatttgactacgcacgtgccattcgtaaataacatctgtactgtcatctatatatcttcgacatatatatcttcatgacgagggtttaagagtctgctggcttgtcaatcctgccttcgccatgagcgtcttctctgcttcgtcattattattctcccgccacctgccaacctgcttcccacgtctcaccggaccactgcaagcgaggatgctgtcgcaatcgagttatcgcgcagccaaagactggagcgccgaccagtatctgaaattcgctgccgagcgcacacgcccggcgcgcgacctgctcgcccaggtccctctgcagtcgcccaagcgcgtggtcgacctgggctgcggaccgggcaactcgaccgccgtgctggtggcacagtatccggatgcccgcgtcacgggcatggactcgtcgcccgacatgctggccaaggcgcgcgccgccctgccggacattgagttcacgctggcggacctgaactcgtaccgtcctgaccccgaggaacacgggccagtcgacctcttcttctccaacgctgtcttccaatggctggctcctgcacaccgcatccgcatcatcaccgacctgatccagacgcagcgtcccggcggcgtgttcgccttccaggtgccggacaacttcacagagccgtcgcatgcggccatgcgtgcgacagccgcggaggaaggacagccgtggacagcgacgctcaggcggctgcagcccggcctcccgccgttcgagtcgccgcgggagctgtacgacgcgatcaagccgttctgcgccagcgtcaatgtctggcacacatcctactaccatgcgctggagggccatgaggcgattgtcgagtgggtcaaggggacggggttgcggccgtttatcgacccgctggcgccggacgagagggaggcgttcctgcggaggtatctggagcggctgaaggaggcgtatccgaagaattcggacgggacggtgctgctgaagtatccgcgcctgtttctggttgctgtgcgggggtagcagatcagcggttgttgctgttgtgtcgtttcttactgttctcttcctacgacggttgttatgatcccgtgttcctgcatttattggtttaatggatgaatcggtgatacgagtgtattatatctgccagcaggtagcaaaaacgccagagcgatgcaatgcaattcctgtttatttttttctcaacagtttatttcaagaaaaatattattcactgcagacttcgtcaaaaagcgaatgctattgcattcttttttttttttacacgagtttacaacacaaagattataattatagtaataaatagtaacgacggaatatgatgtcgtatactgtggtagtacaaattacaacgaggtctctcagcacctaggagtaaatgatcttatccgtgaaaccaagcaagtacccgtgtcaggaaggaaaaaaggacggagaaaggaagctgatcgaccggctatcatatatatatatgcttggggtctaggtctaggcttcatggagcttatgtaccgtacacacctccagggctagagtatgtcatacgtaaactgacagccgcacagcgccgacagcggctgaaataacatttgacaattctatttgaataaaaatgcggggtaagggtctattcttattttacgtaattccccacagtatagaagacatccgatagatgatgcgcagacgaggcattttatctattcgtcatcgctagcaggggtacgcatgctgcgtgccctgtaagcagtgagagagactttgaatcatccacatctatccttgcaaggctatgcattaggatgtactgtacattcactgagtatatgtacgccctcggttaaggcacgggatactgtttctgggggcgttactcattttatactagctatgtgacacagaacgatgtgcatatataatagatacagctagcactcgaatgtaatatgtatgtactaccccatcattctcaactcctccttatgctggctgcaactctgacacgtacccagatttcttctattgtctgtaattcttcttattattcttcttctcgccatgtgcggcctcactgccattctgtcgttcaggaaccggcccgattcgcctgctgttaccgaaaaagaaatcgatgacagtctggaaatcgtcaagcatcgcggtccggatgcgcgcgggcagtggatcagtcctgacggccgcgttggtaagtcagtcgttgtgttaatcatctctgggcaagctgactgttcgtccaggactcggccacgtccgcctctcgatcatcgacctcagcccggacggcaaccagcccttccacgaccggcagaacgacgtccacgccatcgtcaacggcgagctgtacgaccacgagcgctaccgcgccgacctgtactcggaatacgacttccagggccgcagcgactgcgagatcgtcctcgcgctgtaccgccactacggcttgtcgttcgtgtctcacctccgcggggaattcgccctcgtgctgtgggacgccaaacgccaggtcttcctcgctgctcgcgaccggtatggcatcaagtcgctctactatacgttcgtggatggcaggctgctggttgcgacggagatgaagtcgtttttggcgctggggtggcaaccagagtggtgtgtccagtcgcttatggatggtggatggcggttcgataagcggactctgttcaagggcgttcgtaaggtatgtgctgacggctgaaatgtgtgaggctgttgttgatgctgactgactgcggtaggtcctcccgggccactatctgctcagcaagcattttggcgatgtcgagcagagactgtactgggatctggagtaccctgacaaggtagggacccgtcagaagccacttagcatcatcgctgaccatctgtagcgagttctggagacgcggtccgaggcagagatgatcgccggagtccgcaaacgcctcctccaggccgtgcggctgcgcctgcgcgccgacgtgcccgtaggcgtctacctcagcggcggactcgactcgtcggcgatcgcgggcatggttgcgcatctgctcagggagagcggcgcgcagctgggcaacgacgacagtcgggacctatcgcggatgcagtgcttcaccgtgcagtttgacaaggacagcggagccgacgaatctggtaaggagttagctatctctgctgctgctgatccctgctgacggcaaagacatcgcacagcgcacggcagaatggctgggcgtggattttcacccagtgcatctggacgaggcggccatggcggccagattcgaggacgtcgtttggtacagtgagacgccgactgctgatgtcaacgcaatgggcaagctggccctgtctgaagtggttcattctaaggggttcaaagtggtcattacgggtttgtcatataaccccaaagcctggcttttgctgactgtgtttttgttttcaggagaaggatcagacgagcatttcgggggatactcccttctctgcgccgatgccctcgccgagccggattactcgtggcctgcctccatcctctccgagttcgctcgcggagaggcctggagagcggcacgcgcaaaggtggacataatgaatttcgacccaggcgcgtccaccgtcccagcgtcgacagcacgcatgctcaacgacaccagcatcgccacggctctgtccacgcatacgccgctccccttcgccccctggacagcggcctgttacccggacagcaacccggaaaccgccctcgcggagagcttcgacgggcgcgtgcacgaggccatggccaacagatggcatccgctgcacacggccgagtacatctggacgagaacgaccttcccaaacgtgctgctgcggtacgtgggcgacaacatcgacatggtgcatcacgtcgagagccgcacgcccttcctggaccaccacgtcacggaatacgccaacgggctgccgccgagtctgaagatgaagtacgacccggccacccagtccttccgcgacaagtacctcctccgcgaagcgatgaagcccttcgtcacggcggagatctacgagcgcgccaaacacccgtacatggggcccgcccggttcgcggagaacgggcccctgcacgccgtggtccggaggctggtgacgcgcgagaacgtcgccaagctggggtttgtcgactggagcaagaccgaggggttggtcgagagggcgtttgtcgacaaggatgcgtttgcttttcggagggccatggccgtggcgcagtttgttgttctggggcaaaggtttggtgtgaagactgctgctccagaagcagagtaggtaataaaggccatgtacagcaacctatctgagtattgcaaccggagctaaattgataggtgttatcagtgtgtgtagtgtactttaccatgcaatatgacaatcttctatgagagttttttgataaaggggatctcttgcctaatgcggtaagaatgagacagagaaccctaaacaagacaaagatatagaattattggcgagaaacaaaacaaaggcttactatctattcttgtttcttagacagttgttagactgctaactctatacgttgcaaatgcggccagaagccatgccatgacattcgcttcctagcaaaactctgcaacatgtcgtccagattgtaatgttgcatttcttcattgtcttttatatgaagctttatatatcttctaacctctatcgtactcaagccttgacccatggggtcggtcgggtatcgttcacatggccgttggactccgcttctggaggcttgccccatcctccgccgcctgaatttaacaatttagcatgctgaaataagaataaataaaaggaggaagcttacccggcgaattgacttggatataatctcccgcattcagctcaatcactgccttggcgccgatgttgatcttctccagcactccctccgcattcttcttgaacacaaaattgcgccccacgctccccggctcacccccctccagcccgtacggactgtagacccgtcgctctgacaacacgctgaacttcagcgggatccgcgcctcgatctcccgcgtcaccccgtcgcctccgttgtacagcccccgtccaccggtcccccggttgatcctgtcgcagcgtacgatcaccggcgtccgcttctcgatcacctccgggtccgtcgcccgcgtgttggtcgagtgcacgttgaccccgtgcgctccatgccaggtcggccccgctccgctgccgccgcccaccgtctcgccgtagttccaccccggcttcacctcgcctgtccgcgggtcctttccgcccatgccccagcccagactgttggcgcagccctggctcgccgctgccgccccaaacgccttcaggatcacgtctgtcacccgctggctcgagatcgttgatccgcagatggccaccgtcggcgacgggttaaggatcgacccctctgggatccggatcgtgcacgggttcagacacccctggttgagcgggatgtccatgtcgaccagacaccgcagcacgtagatgatcgccgagtgcgtgatcgataccggcatgttcatgttgccgtacgtctgcgcgcccgtgcccgcaaagtcgaacaccgccgtgcccgcttccccgtcgatcgtgatctccacctgcaccggcgtgccgtcgtcgaaccagtccactgcccgcagcggcttgcccccggtcttcttgtacattttccggaagaggtctcggatcgccagctccgcgttgtcctggatcccgcgcatgtacaggtggactaccggcagggtgaactccttgcagagctggttgatcagcgtgatgccgcgctggttggcggagatcttggcctttatatcggagatgttgtcgttgagacgccgcgtcgcgctgcacccggggtattcagccacacggttgaagaggtcccggacctcgtcttccaggaacaccccgccgctgacgattttcatcgacttgaccgccatcccctcttgccacagttccttagagtccggcaccatgctggtgattccgatcccgccgatgtctgtgtggtggccccgggaggccacgtagaagatcagttcgtcgccgtagaaggccggggtgacgactgtcagatctggcagatgggtcccgcccgcttcggggtggttcgtgaggagcacgtcgccgggcttgagcttatcgccccacagacggtgctgatactggatggcatactgcatgctgccaagatggatggggatatgcggcgcgttggcgacaaggccgccgtccggcgagaagatggcgcaggaaaagtccagccgctccttgatgctggtgctgatggaggtgcgctggagcgtgttgcccatctgctcagcaatggacatgaagcggttggcgaagcaggatagctggacggggttcaccttctcggcgctgatctcgggctgtcgatcctcggtggcgtatcgatcgataacgatgtggcgagacgtcaggaagcattcgtagcctttttcgacaaggatcgtctgcgtttcatccgtgatgatggcaggaccctacacagttagcaataaaaagaataacaggagtttttcatacttacctttatataagaccccgtcttcatcgactcgaggccgtaaattggcactgtctcccacgcatcatccaagaacaccttctgcgatgatttgggttcggggattatcttctgttgtctcgccctgtcgagctcttctgttatcgacagaccttcctcgtcgaccttcctcttcgcggtaccacgaacccggatgctgtccacaacgatgtctctgttcgtcttgaacgcaaactctcgcagatgctgctctgtgaacgcggcgctgtagtctccgtccgctggctcctccacgctgagactcgtgtccatgcctttgtactgcaggttcaggaaggtctggaactcgatctcgtcttggacgacgtcctggctgcgcaggtcgttctccagcttcgacttgaggtatttctcccgttcgcggatttgcagcattgcgtcaggagacagtgtcagagacgagggttcggtgacttcggaggtgatttctgccagactgattccgtacgcggataggagagatgagtatctgtgaatcaggatcctgcggatgccgagattggacgcaatggcgcatgcgtgttctgcagtcattctgtcagcaaccatggcttcacgactagggttagggcctgcatacgtcctcccgctccgccgaaactgaccagattgtggtcatatgttgcaaacccgcgcgcctctgttgcattccggatgggccggcacatgctctcgttggcgactttgataaacccgtgtgcgacctgctccggagtgaattggacctctgactccgcgttgatctgagcagtgaactctgcaaatttcttcgcgacgatttctgtgtctagcggctcgttggccttttctccgaagatcgatgggaacgacgacaccaccagccggccgaggaagaggttggcatcggtgatggtcagagggccgccttttctgtagcatgctggaccagggtgtgcacccgcactctgttggagtcagaaaaaaaaaagaagtagaaaattatcacttcatctttagaacatcactcacctccggaccaactactagcagtccattccgcacaaacaacatggaaccgccacccgctgcaaccgtgttgacgttcagcatgggcgtagagatcttgcgaccagcaatggtcgattcgatgatatgatcgaacttgccgtcgtaccgggagacatcggtgctcgtcccgccctaaccacaaagtgagctttaaccacagatgagcaagggagtcgcttatcataccatgtcgaagccgatcagagccttcgggtccttaggatcataacacgaacgggcgacgccaactacaccgccagcgggtccgctcagcagtgcagcgtttccgctgtacttctgcgcctttctcagcccgccgtcggaggagatgaagtcgactcgctgcggaggcacggcaaagccgtcgaggaagttgtccacataatcgcggacgatgggcgagagatacgcgtccgtgcagacggcggtcgctctgtggaggattttgatgcgaggactaatctctgacgagagggagatggtctcgaagccttcctctttcgcgagctgtccagctagtcgctcgtggtctgaatccgaaattagatttagtatgaatatcaacttgaagactcacttgatgaccacatacccgggaaaatatgcgagtgcataaagcaaatggcgacggaggtaaatccctcctggcgcagccgttggagagacgcccgagtggattcgacatccagcggctggaggatgcggacgacctctccgctgtccgtcttgacgagggcggggtcatttgcatcaaactcagcaggcggataaggatccagctcgtagttctcgatggtcacgcgctcttcgacctcgacgacgctgtcgaagagcaccttgggcttgcggatgttgaggtcgaagaggtgagggcgggactggtcgccgatctcgcacaggtcttggaggcctgtcacatgatgagcacacccatctacacagacagaagacagtgcatccatacccttggtagtcagcagcgcaaacggcttgcccttgtgctcgagcagcgcattcgtggccaccgtcgtgccaatccgacacgactctgtttttgtttagcattgatcttcagatatgaaccagaggcgtcttaccaatggcagaagcatccagcttctctcctactggaatctctcgcccttcgactatctgcaatactcgtcgaatggcctcagtgggcgcatcgcggtagttctgcggatcgacggagaggagcttgaagacgaggtcctctcgccctgggatttgggcgatgacgtcgcaaaaggtgccacctcgatctgaggaccgttagaacaacacctacactgcctacagacaggcatatgttcatggtttgcttgcctattgcgattcggatgccacgacggccattatgattggccatttttcgagatggtgatgcgaaacgagcgaggttgaaaggtcggcaggtattctaatctagaatagaaagaaagttctatagaaaataaataaagattatgtccggaagcactgcaagccacgacaggggtcaaagtatgatgctgctcgccaactgcacgtggagctaccaattcagtaacctgtcccgtagaaaggcaactctatcgaacggaaccgaagcattgggaaagcttgttcttgcagaatatcgtccggccaatggaaggatatttcaagcgagacgagttcaagttcctgacaggtctatggagcataatacttatccgggcgagacaggcacggtgagcctgcacggtctagttcgtgtgctcattgacggattaaatggcgaaatgccattagtaccgagtatcgagaggtctcgttgcgatagacgggcaagaagccgatagtcaaaggtggggaatccagtcgcggggtttgcacgttgacgtcggaagttttccgttatcaagcatcagatacggagtactccgtccgggctatactaggcacgattaggtaggtagattccatgcaaagaccttggcaagaagcaatggatcagtcagtagaaagttcgagcggatttggatgaacggtctccttagtctgatcatcacacacatccagcataagaacagctgatctgtatatatgcggggttatgtccagggggcgagactaagaatctgacagatgacgaatggcggtaatgatcgccagaacaaaaagggtctattttgcagctgtgaaataagaatttatccaggaattccttttctataaaattcactgtcagccctgcaagaactcaaaccacaatgccgggaggatagctcctgcctaggcaggcagttgctaggcaagccactaaccattgaatcgggaaggagcccgcggtgcagttccaccccgccgataacgtgcttgcgggcccgacacacgccatctatccagcaacactccggagtcacggttgatggcaacagtgccgacgctagaacagcctgggagcttgtctatcactaattaaataataatgcacaattcaaacatcaaaatgcagctgacgcgcgtcacagctcgccctatatatatccaagcccctctggagggccacgggcggttcaaccactggtcgatcagctgagaatatacggagtaggtgacgatggcgatcgatactgcacagtcggatgcctctgtcatccggcaagatgcctcacgcaagaatccgtcgttgggaaagcgcattctgggtctgctgtgggattctctcgacgacaagagccccgaagagcatcgcctggttagaaggctggattcctgctacttgatctgggcctgtttctactactttgtcatgtatctcgattcgagtaagtggtccatttatcacctgcatcttttttttttgagcactgctgacctttttttagccaacattagcaatgcctatgtgagtggcatgaaagaggatctccgtctgtacggtaacgaattgaactggatgaccacgtattggacaattggtgagcttgttgtttccgcgcctgcttcaatgtggtgctaatgtatgctatataggttatatccttggaacgctgccgtcgcagtttgtccagatgcgggttcgaccctcgcgctggcttcctctcctcgaggtcatttggggcgggttggtgatgtgcatggccgccgcccccaatgccaaaaccatctacgctattcgattcctagtcggcatctgtgaggcgtccgcctaccctggcatgatgactctcctaggcaactggtatacgccgcaagaactggggaagcgatccgttatctttcaacagagcagcgctgccgcgcaaatgtttagcgggtgtgttcactctccactttcccactttcttcgcgctaaacaagacgcaggttcctccaagcaggaatctacaacggaatgaacggcgcggctggcctcaaggggtggcggtggttatttatcttcgatggcatcatctcgctgcccattgccgttctgggtttctggctgattccagatgcgccagccaacacgcgtgccctctatctcaaggaagtagatcgaaaagttgcccaggcgcggatggacaggtacggccgtgctaaagccagtggcatcacctggcgaaagctccgtgatgtcctcctccactggccgatgtgggtgtttgtcgtaccatatgtgtaagactctcccagatgtggtttgttatcaacctgtctgttgacgttctggcgacagttcgtacgtgttagcgctgcacattgcctcgtacatgaatctctggctcaaggcattgaatatctactccgtggcccaagtcaacgtcatcccatcaggaggctatgcgatcgagattgtgatggccttggtctatgcgattgcctctgacgccctgggcatacgatggcccattatcatgatcggagctgccttgggtttgctgggcgggattctgcttgcagtgtgggagatcccgtttgggctgaagtactttgcgtggttcctgacctttgccccggtgggcacgggcgcgctgcttttcgcgtgggggaacgaactctgcggacacagcgcggaagagcgggctatcttgttggggtggctcaacacgatggggtgagtgtgatatatccaaggtgacatagcctgtttttcgacactaaccgggaatgaacagctacgtcttcaacgcctgggtgccgctttatgcttatcctgccagcgaagctccaagatataaatccggctacaaagtcaacgcggcattgtgggggatctatctggtgggaatccctgttatcttgtggttctcgaagcggttccctccgagcaggtccaagcaaccggacgcggaggcagaggtggtgtatatcaccgacgagaaagagaaggagaccagaaccaataatgcaactgcggagaccactacggaggtgaaactatagatagacaggcagagttaaggcaagacataccaacatacatatagtaataataataaatcagacattttgcctttcctttcctttcctttcttttcctttccttttctttcttcatttttttttaaaattttataacaatgagccctactaccccaatgtaagtaatatccaaaacagaaaatgatctcaccatttctccttctccttcctctccttcttcttatttttgcaaaaggactagatcctttctttccctgtcggacaacatggaaaagttaagactacaaacaatctgtattctaactattagttagggctagggttaatactgcgggcgattatcaagatcggcgctagtcccggactgcttatcgtgtggcccgtgcgcagccaaaataaacaacattaagtatggatcggtgattctgttaactctcacaagcttgaagtgagcttgttgcagtgatgggccgcgtttgttcggaaataacttggtttgaagaagacaaatggatcggatctgaagtcgtttttgatcgacccagtccatcgagatggaggctggaccggaaagtctccgagactgaaagctgcgcgactgaatatgaaggcagggagtaccatgatccctcccaagcacgaggcgtttttgcgtgctcaagggttggggactcggcccagaagctgtgatcaagattaggatgcagtgcgcggccccgttccctgctcgggggccttcgagatctaaaccgtgtcttctttaggataccgtatctggacacagtccgcaagtctcgggaggagtgggcaaaaagggcaaagccagatatagacatgttttcggaaagcgagatcagcgcgctcgaccattcgaccaaggcaggctgtttgtcgacgccagcactgtttgcctggaaacacgagacccaagataacaacggttgggtcccagggggttatattgactacatcttgatggagaaagccccagggatccgcccacgctatatttttgccacaatggatcggcaagagcgtgatcagcttcgagcagcgttcaaagaggcatggttgtaagttgttctgcacactatccattcctcagcgggaagggtagaaatgaaaagctctgactcataatgtttaccttggcagagaatgtattgcctgtgggatggaccaccaagactgcggtgtccagaatcttgtctgggatcgtgaaaagcggaaatggtaaatatatcccaacctacgagattcctataggtgttgcatggctttctgcgtcacctggcttgctgacggagaatttttggtccatgcagttatatcgtagactgggagtcatgggggaaagccactgctaaacaggtttggagagatcgagagtatatatcatggaacctaggcagggttcgaaatggcaaccgagaagacatgtcaacatgggttctgtgatttgcccgaggatgaagtcgagcctgggaatcagggctttcactccttccgtactttcatctggtgactggagacacttaaaacacccgtaacacacatggcgtagggcacggctcacgcgggtgagcaatgagtgggtggtcggaggaagtggcgaaacgtggaggtcattttcaataccataagaaaacccatgtaacacggagtttgggcgttgggttggcattttggttttgtcaagacggatggaatacggatcggaactggcgacagggtcagctataaattcatcctcaagactatattgagtaataatatttccagcgattttcccgcaaaatcatatgctagagaatttagggttaaaaggctggtcccaaattaacaagagcaccgctattcctgcctagggtttagggcccagggctagggcaggtgttccccttggtcaaccctttctataccagatttcgtcaatctattgtccttcgtcgttgaatctctttacatcaattgaaaaccaaaaatcttgcaaaagagaagatagagatgtgtgagagcagcgaagactccggataatgctacccgatcaaagcggagaggagagcatccgacgtcgcagatcatttactccacatagtataaaactgtcttctcttgtcccagttttgagacttcatcgtacagtacatgcatctggccgttaatagtttaagttagtttactaggtacttcgatttatccggaaacctgactgactatcgtgttccccagttttttaccccgcattgattagatgattagatcggtgatcttcaaggccttttttttcttgggatcatctaattttctatttaaaaggatatgtttcttttataagaatgcaatgtagaaaaagtatttttctgttatttctatcttaactatgcagtggttgaggattatcacatgatctccccccagaatgaagccattattgctctcaatgctttccgcttttcttttctcttcaccaacgctgtcctcaccacaaagcgcgtccaaaacagagaacagcacagcaaatacaccagggattcgtctgatcaacggccatgaacacgttctgattcagccttggggagcagatgggttccgtgtccgggccactctgaacagatttcctgacagtgcgtagccacggaaaacgcatcttgttcatctgactaatttcttacctgctgattgacactctgtagatgaagcgtacagcgtcatcatagatccccctctggacggcccgcagacctccccatcggcaccagctacagcaccatcaatgcgacacaaaccgccaccgtgaccaacggccatgcctcggtggtcgtcgacaagggccagctgagtttctatcgcgtaaatggcaacaacagtaaaacactcgtcttgcaggagctgtggctacagacaccgggattcccagcgcgatggtatcaaaagagagatgcaagacggggctttcgagcgcagttcagcttcgtcgcgcccgacagtcccacggagcggctgtttgggacgggccaggatctgacgggctctctcatcaagaagaatcagaccatcgacttggtcaagttcaacacgctgaatccgattccgacaatcgtgtccgatcgagggtatctgtttttctggaacgtgccttcgcttgggcagatggagttgtctccaacgaggtatgcatcagcaaaatttgaggaacaggatcatttctaatgtcaatattagaaccagtttcctgagcgatcacacttcagtggtggactattacattgccattcgccccgaagccgactatgacggcctgctgcagcggtacaccagtgtcactgggagatcgcccatgattcctgattttggcaccggatactggcagtgcaagctccgttatgcgactcaggaggagctcctcaatgtgactatgggatttgcagaggtcagaccctttggaaatgataagactgtttctgctgacttgtttgcagcgaaaaatacctgtttcgatgttcatcatcaactatctcagctggtctcacgagggtgactgggctctgaacgcatcggcgtggccagatccggcgaagatggccgcagagggtgagaagagtcatttctaccaaggtgttgtagtctgactggagccgaactgatggcatccgtctggcccagtatcgaggacgccagtcccaactgggctgaaatgcagagcttgggttttgccgcgcagacattcgatcctctcgatattgctggctactggcagaacaaatacgtgcatatgatcgatcctaccaatgcagcagccagggacttcctctggagtaacctttaccggcattactagcagaacgggatccgaaacttctggctcgacgaagacgagggaggccaggtcgcgctcgacgtctacccgtggacggactattacctgggtccgggggatcagtatgccatgctgttcccctactttcatcagatgggggtttttgaaggacagatgaagacagtggggtcgaataatgtttccgctgtgtccctgtcgcggtcctcgtgggtgggctcccagcgtttttgccggcgcagtgtggagtggagatattttgtatgtgttgcacacttttcaataatgtaacctgctgattctggtcaacagcgccaactgggattccatgaagatgatgatatccgcaggacagagcatggccatgtcagggcagggttggtggactttggacattggaggcttcaagacagacgggcagtccaactcggcgaatattagcgacccggagtaccaggaattgtttgtacggtggctgcagtggtaagcatttgaatactccatttcctgtattgataagtaatacgtacaggggaaccttcttaccggtgcgtaaatgaatgccctgttggcaattcaccaactgaacttgacgtagattatgcgcaaccacggaatgagaacctgtctcccttcagcacaggaaggcttcctgacctgtcctagcggtacagacccgtgccatatttttataacccaaataagtatctactgacactgtcaaacttctagaaccctggagctacggccccgacaacctccccatcatcgtgtcctacatcaacctccgatacaaactgcagccctacatcaaggcgctcttccggatgctctccgagagtggacgggcaatgatgcggcccctgtttatggatttctctctcagcgatccttacactttggaggcgacggaagatctgaaattgcagtacatgtttgggccgcgcttgctcgtcagtcccgtcacaacgtatcgcgcgacgaatgcgaccgtctacctgccaaaattgccgtcggatgctcccgatacgaaatggacgtactggtggacgaacgagagttttgacggtggtcaatgggtgagttgtctctctcttttttgatagccagttgactgacattaatttctcaggtcaccgttcctgcgaacaaaagcatgtaagtattcaaatcacgtacacatgcagcttcgaattgaaatattcctgtctgacctgagctgatctgcatgcagaattccgctcttccgactcggcagcgaagcagacatcttgacgaggaacatctaatagcctcaatactatagattcaacagcaagggccaagggtcaagagtgaccaactggaaggctgctaattaagtaattagctattgatcaatcagtacggagggacctagggggaccagctagccctagctaccaagggtggagtacataggtgccaggtatttatttcatccatttctcgtactcctaacccaatctagtaacacttacgatgacctgtttagtttcaaaaattagatccaaaataactatcaaatgaagaacgtcgattcagtcgtgttcgcatgtgaatctctcctacaggctaccccacattgtatgtcctttacggagtacagtactgcaaatgcggagtaaccggctgttccctctcttgacggtaggttaggtcattactcaatcattgaatcttcttacctggataagtaagtgtgtacatgcatgtacggtattacctaggggcctatcccaggtggaggagaggctaaaacatacctaattaagatagatcctggtctataggtatgtactccggaaattcccacatgtcaatgtcgatatactaaataatttctccgcacaatatggagtatgagtacactacgccagttcttggctagttccctaaatgcgtggtttatatacataagcaggggttagtcaggtcgccctctgagtatatattatagactgcctgcgacgtgtgcaattcctttgcactctactgactgactgactgccctgctgtattagctagtacagactcaattcaccatggccaggataccctctcttctccttcctcccctccttctcctagtcgcgcaaacaaccggcctgagcacagtcaacctggtgaattcgacagtgcatttcgatatccattagggagctgtcgaggccaaaccgatcgatcggcaattgattagcttgtctatcgagtgagtgcagccaacgacgtgcccgagacagtgaaagacacaattttactgccaattttatggggcgcatatgttgatcgattgtcaggttctgctacattgttgacttcctcggcgatgtcggccacccgaacctgttctcgcgacagctgctgtagaacgtcgcggaccggtccggcgttcttcccattctgcgactgggcggcgacacagcggaccacagcgtgttcaggacaatctcacagagactatgtacaatatctttgagcccggcaatgccgaggccgtcaatacgacgtacagcaagcgcctgttccaagtgctggcgcagaactcggggccggagcagacgtatatctttgggctgaatctggggtctagtctgtctttcctcttaactccagcatttaatttcaagactaaacattttattggtatctgttccagatatatacgaaatcgctcacgcagaaatcaccgctgcagcaacgtacctcaaccagtcgcgcatcctggcatacgaggtcggcaacgagcctaacctgtacacctacactggactgcgcaacgcgagctggaacgtcctggaatatgcagacgaaatcctcgactggatgccccggttgagagaggcggctggcggccaacgcttccccgggtatcaattcggcaccatcgctgagccgcccagcgcgtttggcgacttcacgcaggtgcagctggcggtcatgggcgtgccgcaggcgatcggcagcgtaaggtatatagcttcgcatacgtatccgcagaatgtctgcactagtaagttgccctacatacagttccttctctgagcctttgtcttgtatgctgatatgatacactcgacacgaccagcccagcaagccgccgccgtgacaatcgactactacctcaaccacctcaacacagtgacctacttcgccaactgggtggacgagatcgccgcggccgagtctctcggcctgcccttccacatgggcgagaccggcacggcgggctgccacggtaaggacggggtgtcgaacacgctgggcgcgctgctacgggagatcgactacgcgctgtacgcgacgacgctcgggatgcggcgtctcttcttccacaatggcgggggtggagtcttctactactccatgtgggagcccgtggcgctgaatgcgtcgagtccggcgcatgtcaatccgacgtatgcccctcagatacacatatagctgtgcgtgcaactcacttactcacttgttttatagatactacagcatgctcttcctcgcagacctcacctccgacctccccacccctcgagttcaccgcctccgccacctagacacctacgacctagcgcactacgccatctacaacgatcaaaccttcaccaagctcgtcatcctcaacacgcacctctacaacgacaccagaagcaccgctgctgcttcccgacccgagaaattcgtcaacgtgtctcccgttctcggccagcgggtgcagatccggcggctgacggggccgagctcggttgcaaaaacgggtgtcacgtggaagggccagtatgttagtgatgctaactgtacggtggttagggaggaggtcgtggagagggtcgcggatggggttgttagagtggcggcttcggagggtgttgttgttcaagttgacaggacgtaagtcatatagccatacatactgtggtattggctatgtgtgtatctatatccatgcctatatcagtgcttacatggtattgtagcctatctaatcaaggtatataccttgttataagtatagcagcagattattaaactggcgtagagatctatctatctatctaggtcatgggccatggaagccttggttcattcataatagtgatcgaaatcagttgcatctacaccacattttgctttaattttctgcattagttttactgttgttttataagtctaaccagcctgatatctactctattcgcacatcttccagtggaggtgtatgcgggcattcctcgcttagcctcctgcattctcacttcttggtggaaacagtcaactccattcgatgttactgggatgagtagagattacatatacagatctatccagcatccagtctagtcttctagtctagtctgtcactacaactccaacgccgcacagtcctcgaccggcttcaatccaaacgcccttcgtccgccttgccagctccacgccacggctgtcctggcaaaactccgcaacgtgtcttcgtactcccctatcagtttggcgtccaccttgtcgactcccccaatctcgacaattcgccgcgcaagatccgccgcgtcccgcagcgccgtgttggccccgacccctcccgttggcggcatgacgtggatcgcgtctccaagcagcgtgactcgtcgcgagggctcccacggcggcaggtccggctgcacggaggaaatgcgcagcgtcgacgtctgcgagacgtcctgcgcttcgaacagcgcgcggattgacgggtgccatttctgcgtcatcgtcaggggcagttgcgccgactgctcgtggtccagtcgcagtgtctgctcgtccggtaacggaacgaggtcgcgatgcgcagcaaacacccagtagacgtagtcgtccggcagtttgacctgcaggtcctctgcatcgtcacggcggaagcgcatcggctcgaacagcagcgtcttaggagcggcctcgtcggcgcggtccagagctatcgccatgccccggagggcaaccggcacgaatcgcctctcgaactcggcggtcagcggcgtcttgccgtagacgatgcgcatctgcgtgtcgatgagcgggcattgtggcaggagttgcctgcggacctgggatcgcagcccatcggcgcccacgagcagcgcaccttcttcgacggtgccgtcgctgaagtgagcgcggactcggccgtcgtgcacctcgtaatgcgtcagttgcttgccgaaaaacacctccttcccctcctcgagccccgtcagaagcaccgcgcggaaggtcttccggtcgacggagaacggctggggacggccgtcgaccgcgggacgcgggccggcccccagggctgctgtcgttgctgggtcgagctggttgcccgtgatagcgtcgagtcgcacgcccatagggtcaaattcagcggaggacttctcgaagagggcccagaggtctggcgtcagggcatactgcagtgcgaggacgccctcgccgctgatgcgcacacggtaaccctgggcacgaaagtcgcgctggccgtctttttcgaacagcttgaaggggatgtggtgcttcttgagggcctgcgcgaggcagagaccgccgagaccggcaccaatgatgagcacagacatgacagtaatgatgaaccgacagcgaatattctataacctgtggataaaaaaaaatattcaggcctaagaataatcaatatcctgttagccggactatatcacactctgtacggacgtacctggttaggccacctgttatcgcagcgcagtcagctgattgagccgagctgagctgcacaaataaacctggtggcagctagtcagcgcctgttggcggtatacatgtacatcgtcctgtacggagaattaatggggaatttcaggctcaatggcatgataaatacacgagtattgcgatcctgtttggtggtggctggttcctcagctgtggtacgcttgcaccccaccggaaatgctctggtggggttcgttgtcatgctgtctttggcacggtagaagaaaagaaggaataaagaaataaataattctgcaagactaaagccacttcacggcctcctaggacttcttaagggtttatggcggtgagttgctccttccctgtcaatgcattcccggcgggggtgcagcaggaaggagcgactcacgcgctggcctggagagaaagagcgctcgtcacctgacatggcatgaacagtcatcggtggaatcggagatatctcatttcatatgctctatactacatgatcataacagaggcgtatatagaacagagatacacgctaaaactccacctggaaccgcttgctcgtccggattcgctctccgaacaaccagaagacgatcggcagcggcgccagcgcaacggcaatgaaccccagcagcgaattcccccagcccagacccagcgtctggtacatcttcccgcctgccagcggcaggacagctcccatcagcgatcggaacaccgtgttggctgccatggcagacgccgagtacacggtgtaggcgtcgaccaggtaggtggacgtggtcatctaacaccagttagacacggaactgcataggctgcctccaggtgctgcacttacaaaggcgatcaacatcccgatccccatgaacgccgtgccaatgatcggcaggatccagtgatccttcttgtctgccgtccatccgtaccagaacagcgccagcgggatgaaccacgcgccgacgatcatcggcggcagacggtactctggcttggccactccgccgttcttcgccgtcaggtacttcagcaaccggtccgacgtcgcccccagcacaaacagcccgatcatcgacccgatcccaatccccaggtacgccaagcccacgcttccctgcgagaagtgatactgcatctcaaagacatccgtgatcgtggtgaagagcagatacaagtacccatagatgacagccacgtagagcgacaggagaaacacaatcggtgagaggaagagcatcttggtcggccgcacgatggaccaggcaaacagatcgcgcggcgagcggcccgtgtccaacacagatcgcaggtttgggttgcctgtctccttccgcaagcgtttggtcttgcggtctaggattatataggcgtaggactcgcgcatgaagacgagcgtgttgatggtgaccgcgccactctgttcagtccgcgagttaggcggattgtcatcgatttgagtcaggggagatcgaacataccgctattgccagcacccaaaaggtccatcgccaacctttggcctgcgtcagatagccacccgctggagatcgttagcaagagaaactcaaagaagaaatgaagatccttaccaacaggacctatcaccggccctaacagaggccccaacgcccatgccgccatcgcaccgccgcgcttctcctgtcggatcatgtccgacagcgagcctgcaccgatcgtcaacgggcaacttcccgcgaggccggcgaacagtcgaaagacaatcaggcttgccaggctgggggccacggcgcaggccacgttgaacacggtgaagagcacattgcagacgttgtagatcggcatgcggccgtacagttcggacaggggggcgatcaccagcgggccaaagcagtatccgagcaggtagacagacacgacgaacgaggcgaggtagacgttgtccgacttgaagtccttcatgacgtctggcacgccaggagcgaacatcgaggaaccgagggggctgcgcaggtcagcagtctatccgaaagtcatccatcggtcgaaccacatacgtcagcagtgtgatgaccgaaatcgtcgccgtcgccacaaacttcttccggaagggccagttcagcgggttcatggggtcatcagggccatcccaatcgacaaggttcggatctcgaggacccgaccggttgtcgtctaccggagtcgagccgcgttcgacatcctcgccctcttgtcggtatccgatcttctcgtcaacgctgttctgtgaaggatgctcctggccatctacggctacctccttggccggcacgttgacgtccgcgattgtggacgattctttgatccaggaccagtcagcataattctgctcttgcgaggtttcttgtcgaccaaccggtcttgacgataaacatacccttgctgtctgacatttatctaaccacgtagaacaagaaatcgacagccagttaatatgtttgcttctcaacagtcgcggcgagggccaggccggagtcggtcctgttgaggttcttccccagcgtggggaaagcaacttctccactcgagaaccagcttattcgccggggaatttagcaataaatcgcgtggagccgaccaggcgcgcaggcttgagacaatagaccgcgctggagggaaatgaggcaaatgggtgcagaacggtctgcaggtgacagactgggcaaggagtcgaagtgacaccatattgtgtcagggtattccatctaatatagtaggccaggccagcgtcgaccgcaccgcgcttaacaataactccggagtacggagtataatagtatagatccactaactccgagaaatttattttgaacgcagccagagccaactcctcgctcctgctattagttagtagcggcgaatagaggcgcgatggcggcatcagggcggttccgaaggcgtggcataacgcggcgcatggacgccatgtgcaggcagggtgcacaacagcccagcataaatgaaggacgcggggtcattagtcaggcgcatgcacaataatgcaagctctctcgacaacggagacggaggagctgacacccggtcgcgtgtgcataactctcgtccacaagaaaacaagcatttggcaggtcggaactgaagcttagcgcatccccctgattggctgacagtccacacgtgaccggcatgtcggcagttctccgtgtttcggctcacctccggtgaatatccgtttgggtaaagcctgaggattcggagtatgaagtcagaatgctgcttctatttttgcagcacctcagacataccatgcgctgtcattgaccaatgggctcaagacgagaaggatggttaaggccatgactgacgaaaagataaccagcgagaaatgtatacgctgtactgtacatgagcagatgagggtcatatgtatttcatacatatacacctttttcactactaacctggcagctagcctcacactgaattatgttttttggtctctcgcctcacaccaagttatagatggtttcgagatacgtcttatgttcttcccagaatgtaatattgtcatggagtaagtatagtaggtagattacgaagttgtactgtactgtagtttgattgaatcaaactgtgggcgggaaaaaggggtcttttcaaaaaaaaaaacaaaagatactattaagacattactcagaacaggacggcattcatgggggaaaaaaagtgaaaatcgtcaatctttttaactgaaatgctagttatttagacatcatttcttcttccttttttttcccccttgtagacaatgggcttgttttgatccttagatagaattaattaagttcattttcttttaactttttgaagagactgttcataaactgtcaattcgaggaggtctccagcaggccgctttccacgttatggtattgatttttacggttacttcttactcgtacctaaaattatagaaaaaagacattggaattacatgccaaatgtcacgtaagaagaaaaaaataaaaataaaatgaccatgaatcgtcaaactggtagttatattttgaagaaaaaaaagaaagaaagagatcttgtcatttgcctatcagacaccaatattaataattatttcacttcagatcaatgtgatatgtggcaccttcgaataacctccacacagtaatgcaggcaaactagcagtaagctataaaatgttgaaacccagtgtggcgtgcagcgacatcgacgccctacctttacagtatgtagttggatcctccacctcatcacgtgtggaaggtcaatcattgaagcacgtggactgtccttttcctacactgaccgtccgtagtaagtagtctagaaggtacattgctccttatacatacttgcttgacagcataacgcgtcaatagtagcatgcagttaccgtgatatatcagctttctcttttttaataggtagcgttggcgtcaaatctttgattcatactatgggtcaccagagtcagtgttaacaggccaggcaaaaaaaaaatagcatgaaactgatttaaaactggtttttaaatgatccacgatcgaacttgacattccttctctcttggcagtcagtagtagaacaagacctcgcgtaaaatcctggctagtttaataaccacctgcaacttaatactacaactccttttgccgattggcgcgattgccgagattagttctaggaattgttactcttacggagtagaggtactccgtactcagtagatcagtttcccttaggtttcttgccgagccagccacaaaagaaattaaaaatagactgacaaagtcaaatgcacctaaggtggtttgggcaaggcgtcatgcgcagatctgcccatcgactggacttgaccgcgacttgcagttacggggctggcggctggccacatgcggctctcttcaattggccagtcatattcctcttaacttggatcaatccattttctacgcacagttgcagttgcagagtttgttgcagagagtttttcagataatacagacggcaggctgtgtaattgcgtattacgtacggatacagctttagcaccaacttggtgattgagacacgattgggtcattgacaggattttgtatatgttgaggtaaatagaagtcgaaattctacacgtctatgctactggactccgatgcggtaggacaggttggaatttgagggcccgactcggagtaaccgcagaacatcgcaacccaacctcgctcccagtggaattccagaaagcccactgactccatcccacgacagcgacatctgattagattgattagattgatacgatgcgaccctgcccatctgcccccacatcgccgaaaacgaaggagcgccggtgccgccgctcccgccccgctcctttccgcgaacggcaatttcgtcttcccttcgtcctcctcgtcgtcctcctcgtctttttcttctcatttttacgccaggaaaacgtggggtcggatcgaatcgacatgccgcagcttgtcgatctgtctctcgatccattctggtttgctaactcgtcacgagcgctgggaagctcgctattcttactggccagcagccgagggtcgttcggatcgatcggcctgccttggacttgaagacacaattctatggcctcctagctcgacaattggctttggaaggacgtaatgaacatctcatcttcatactatctcatcttcttcttgtccggttctctatcgtcgcatatattctgccgactcctggctcaaccacactacttccctcttccacatcagtttcctcactgacagcacttttctcacaccgcgacgtggccacagaccacgtacctcaatgactgcctcagttcaggaccaggagaagactcctgatctccaaaatgccgactgcgaagcggtaccggtcgatcgtgcacaagtggacgaagacaaggagcccataagccacgagttcgtcgaccgggaacatgcccaacggggtgtccagaaagccgccgcaatcaccgctgcatggaacaaaaagtctttgattctggcatatgctgggtatgagcgcgacctatctgtgtaccactgacgactaactcaccggcaggatcttccttgtattctacgtgaactcgctacagcagcagatcagcggtaatctcaccatttatgtgaccagctccttcgcagagcatcccctcacggcgacaaccagcgtcatgtccagcatcatcggcgctgtcgccaagttgcccattgccaaaatcatcgacatctggggccgtacggaaggctatgctttgatggttctcctggccactttgggtatgcaattacaatcgtgatcggcgaaaaaaaatttgctgactgaagccaggattgattatgatggcggcatgcaacaatgtccagacctacgccgcggctcaagtattctactgggttggatatgacggaattgcttatgtcctggatgtcaccatggcggatacatcctccctcaagaatcgagcatggatcttcgcattcagcacctgcccatacatcgccaacaccttcgccggtcccgcagccgcccaacaattctacaaacatagctcctggcgctggggttacggatcgtttgccatcatcgtcccagcagtttgcactccattgatcatcatcttcgtcctgaaccgtcgcaaagccgcaaagctcggctatgtgtccaaggagaagagtaacaggacggtgtggcagtcggttctccactatgccattgagtttgacagtcggtctccaacgtctcaaccaaatgatcacttactgactagacttatcagttgtcggtgtcatccttatttctgctgcattcgccttgttcctcctcccgtttagccttgcctcttcgtcggcgcaagaatggaggacccctcatatcatcgtgatgatcgttctgggtggcttgctgttccccgtgtttgtggtttgggaaaagttctttgctcccgtctgctttgccccgttccatctcctcatagaccggactgtcctgggcggctgtctcctaggagcaattctatttataagcttttagtatgcctttttttttgggtcaaagttgaagaattaactaacgatgtcgcagctgctgggatatatatttcacttcgttcctccaggtcgtttacaatctcagcattgcagatgccggctacgtctacaacatctacaacatcggttcatgcttcttttccgttctagtcggattgtcagtacctgattcttgttctttttgtccttcatcgctgattgtggcaacagtgtgattcgcgcgactggcaacttcaaatatgtcgcccttgctgccgttcccctccagatcctcgggaccggcttgatgatctatttccgtcaaccggacaagggtatcgggtacgttattatgtgccagattttcatagccctgtctgggggaacgctcgttatttgcgaacaaatggctgtgatggcggcggctgcacactacgaggtggccgttgtgctggcccttgtggggttgtttaccagcattgggggtgccatcggtcagaccgtggcggcggcgatctataccaacctcatgccgggcgcattgcagaagtatctccccgacgatgccaagtcgcaggcgacggccatctacagcagcatcaccacccagctgcagtacccgatgggcagtccagtgagggagggcattatccaggcctaccgagacgtcatgcgccggttgtgcattgcgggagtgtgctttttgccggcggcctttgtctttgttctgatgatgaagaatattaacgtgaaaacggtcaaacaggtcaaaggaactgtggtctagaagagcattcatcacatagccagccgctaaatggctggctttgagcataccgctgttgcaggaggctttctgttgtttctttcatctttgttttggaggaaatatcattaatttcgattcccggcactatccttagaggagtggataggattgaatgatgtaaattattctcataacactctctgaccgtatgtacgaattcggctcaagtttatgccacgcttagtaattgcgctgaatccggcaatcgtcccataaccgacggtgattcgtccatgcttaaggacaccgctgcacgtggtttggttctcactttgacaagagaacgcgaatacccatagaaagctgccaccaatatacctacataggtagtaggacttagaggggcctcgatacagtgtcattgtggggtattggaaaattacatcattcttgtgccatgtcaaaagatgaaaatcgcgacgaaccacacaggcaactcggtactattagtattgtatatactagcagtcagatggactgactacacaagctagcttagtgaacatcatcaaacgcgttcaatgcccttagttaggaacatagtcatcaactctcttgtgttaaagtactccgtaccgagtacggagtaggcaggcagtcagctgaccgattaccgaagatgatgtaatcccactatcgcgtgcttcccaatccgccaatcagagtgcgctgatcctctgccgatccggtgcagggattgatttgattggcttttatctcgtatctcgtaattcctcttagcagatctggcacgagccatgccggggccccggtcaggccttatctacgcttgtcgattgttgttattattgttacttcgccttcgcttatccatctatcctcctgacatgctcccatcacgtcaactgcccgacatctgacgacaacttttggcggtcgcaggcccctgtcaaggaccaggtggccgcgatgcacgatccccgcactgcgcctgctgagcaacctcggatgtctgaaaagcaggtaagcaagcagcgcttcctcctcaacaggatccaataatattgacccagaacaactctctaggccgtcgcggtctgtggtggtccctcctccccacgcttctcgaaccgcttcaaaaaagttctcgtgatcctttgggttgcatactgcctttacactctttaccgtcacctctgcaccatattttcacacaagcaccatgaccgtcagttgcagaccaatggcgcgtatgcacacgggaaactgggcgctgttgcgagcgagagtgcgatatgcagtcgccacgggatcgagatgctcaagatgggtgggaatgcggcagatgcggtgagtcataccatcagtaaataccgacagagagagctcggataggatagggcttctgaacactgctgactcgaatccagctggttgcgactgtcttctgcgtgggcgtagtcggtaagcaatgagcctgtgcctggcagttatgaggctgtctgacaactgcaggcatgtaccacagcggtatcggaggaggaggcttcatgctggtccgctcgcccaacggctcgttcgagtttgtcgacttccgcgagactgcgccggcggccgcgtttgaggatatgtatgagaataacacggctgggtcggtttacggcggtttagcgaggtatgcactgaaaatatcggaattggcatgaatgaatcaactaaccatggagaagtgctgtaccgggcgaggtccgcggtttggaatatcttcacaagcactacggtgttctcccctgggccacggtgctgcagcctgcgattcacaccgctcgcaatggctttcctgtcacggaggacttggtgcggtacatggaagcggccgtcggggacggagaagattttctctccaaggacccaacctgggcgctggactttgcccccaacggcacgcggctcggcctgggcgacaccattactcgaaagcgatatgcagatactttggagactattgccaaccagggagccgatgccttctactctggtccgatcgcggagaccatggttcgagcggtgcagtctgacaacggcacgatgacgttagaggacttgaaaaactacaccgtggcgatccgagatgtcgcagagattgactacaggggatacaagatcaccagcacgaccgctccatccagtgggatcgtgggtttgaatatcttgaagaccgtggaaggatatcacccattcttctcgccggagactgtcaatctgagcacgcaccgcttggacgaggcgatgcggtttgcatatggcaaggtactttcggattaatactgattcgctgacggaggctgacctcttgaagagaaccagtctcggcgatccgttcttcgtcgatgggatggacgagtatcagagagatatgctgaacgactcgaccattcgagacatccgccgacgcatttccgatttccgcacacagaatgtgtcggcatacgaccctgatggactcgagagcctggatacgtgagtatccttctgaacttgtcgtgatgacttctgactgactggtttcagtcccggaacgtcgcatatcgtcgcctcggatcattctggattggccatctccttgacgaccacgatcaacctgctctttgggagccgacttatggtgcctgagacgggaatcatcatgaacaacgagatgaatggtacgtctttaaccgataatatctgatccagtgtaacacgtggatctaaacttttatgcagacttctcgattccaggctcgtccaatgcctttggatacgtgccctcgccatccaactacatccgaccgggtaagcggcctctgtcgtcgatcacgcccatcatggtgacacatccgaacggaacgctgtatttcatcaccggctccgcaggcggcagtcgcatcatcacggccacggtgcagagcgtcatccacgtcctcgaccaggggctgagtgcccctgaatcgctggcccagccgcggctgcacgaccagctgatccccaaccacgtcacgttcgagtacgcctttgacaacgacacggtcgcgtttatgcagggtcgcggccacaacgtcacctgggtggcagcggggcagagcacggcgcaagccatccgggtgctgcccaacgggacgttcgaggcggcgggcgagccgagacaggtcaattcgggggggttctcgatatgagtcctgcgtaccgtacatctacgaacgagtgaggtatatatagtcaaattctggtatatatgggcttatatagtgttcttatatctaggctggttctcaatcaaaggggaggggacgggtttagaagattacctttttggtgtagtgttacccttgtatgtccagccaaattagtatatgtagctttgcagcatataaaggccacattgaccaatagagcatatttttatccttaacagttggtatataacgcagggtctatacgaatcaggtgacaccactgaggcgctaaccagacagcgggagcaaaaatgaaccaacagctctaatttcttgaccatgactcatgaaatactcagagacagcctgcaataatatataatattggtatgttggaggaagcagatgataatctactaacagtctcgaacatctacagcgttgcatccatctgctgaaaatattgatttcaaatgcttcacaaactcccacatgagattctgctggagatcgggtcatttctcgaacaggacagtcacataaagctggcacaaagttcaaaatacctctattcattctttcttccccttatctacagcaatgtctcccttggaatgaccactagtttttgcgcggaaggcttcttccccaaaccaccgctgtccttaccagtcgttcgcttcacccagacaatccttcagaagccgcagctagcaagcctagtacactcgttagaactgtttacggatgcgggcggttgggatgtaccgactgcagaacctctcccttctgcattctacgagggcattgtgcgatcggcctgccgttccgagggagaattctcgcagtggctgaacgatctcatcgaaggagaggaggatgcctggctcgcactgttgctcgtccggcttgaaaatctggagaagctgaccctgccccttccagaaccagagtactgcccacatctcacacggatcattgaacgagcggcggacgcagaaccccggtacttatccaacttgaaaaatgtctttctacgagagggtccgaccttccaacgacagggccatatgacgatcccccgtgtgctgcccttctttcagatttcatcactacgaagctttgaggcctgggatgttgcagggggcggttgtcgcctgttggaattgttcgacggcacctcaactgtcaccagtatccaattggagtatgtgacagcaggcatatcttaccggagttgccagacttgatatggctgtgtccacggctagaatcgttcaaatacagctccggaaagcaagtgtatgatgacgacccagagatcgatgtcttcaatcccgttcccttgtatgcaccactccgatacactaaagaaacgctaaaaaccctatcgctggagatgcacgaacttgtcgattcattagtatggcagactgcagacttccccaccagacggtttctggcttctctattggatttccccgcgctggaaaacctatgtatcaggttgagcaacctggtggaattccacggccctagcagctgggaccccgtcacaccgctggtcgatctcctaccgccgtcactgaggttcctgtacatagtggacttcaacacggaagctctcccccattggatcgacgagctgagcgaagtcgcgaagcatcgcaacacgcgtttcaccgtgctgaagaggctcttcattcgcccgcctgggcgggagggcccaaatgatgacccgcgctttcgcgtcagggtctatacaggcagagagcgccatgttccaccgcagatcaacgagttggaggctgcccttcgcccgagggttgtcgcgttggaggagagattccgggacgtcagtgtggagtttcgactcgtttgtagatatgaggtggttgagtttccttaattgaacatatctaccttgagatagatatctatgcgtgttttgcaggtgaatataatattctcttctttcttcatggctgttgacgctgcaagaagaaaaagaaggctataatggtacgtcaggggtaaattcgatgttcttttgatggcaggcaaacaagattctggcttaaacaaaaaaaaaattcctctattaccctgtaaccaaatgaaacagacagaaggggcctgaacttctccaggcgtctctcggagtatattcaataatacctacctagtaagtaggtacctaggtaggtagttctgcagcctcttccattttttttttggccatttctttttggttcggttcatcttgttggttttgggggggggaattcattaattaatggttatgatgttaattttttattcggagaggatcttgctgtactgtacagtactgtgcatacctatttgctcaactaacttttctttcaaatcgaattgaattgaattgaattctgtgaatttttgattttgatttgatgggttcaagcaatgaccggctgaagaagaatatcaatgatttatttatttatttgttctggttctctctctctcttcttttttttttgctcttcgaatagtatttttatttatttccaatcttgtttttttttgttggttgcggttttgttgatatgtacaacatcaagtctcttattttttattttttttatatttatttttataggtcatacatacatatatagctcactatacggcctttctccctccctctctctctcttaagacggttttttgagattgcataggtacttatctgataggaaggatatcattgtcaagagtcttaggcgttgttcctcctagggcatatatatttggtatatataatatatatctctaggagaacagatacagtgatttacaacgtaagtgaggtatacctccatcgattgattaatcaatggggcgtccagagacactagagattacgttgtctgtccgtccctcctggaacggatagtctccatatatatatatatatatactttaataataagggtaatatactgaattagtgtcatgaacaataatattatcgctctcgtttgtcctgatgctgtctgtattttgtacagggtatcgtatctatcacggtaataacagatggaacaaaagcctaattcatcatatcccagtgacaagacaaaatctcctctaacaagaggctattcgtacgtagacaccttcactggagacatctccaacacccaattaccatcttcctcatgagcaagacaccctcgcagcagcccgcatcatcttctcgcttgctcgggtccgctcccctgtctcccggtcccacacccatccttccttcagccacatccacgtcagatacgcccttagctccttgtccatcggcaggacgcgcttccattccggctcaaagtccgctgacgatgtcgcgttcgtccccttccaatcagacgccagaccgcggagttcgtcgcggcagaagatccgccagctgtcgatcgcataggccccaatccccggcaaatgcgctatctcccatgccacgcgcgggtcgtcgtcgtcaatgcactcgtccggaccaacgtctcgtccatcgcccttcttggggtaattgagcttgcggtaccgcttccctttcgttggcggcgccaccaaccatgtcttcgcgagctcgatgcatttcttcgcgcgctggttctggaaacccagacagtggatcgtttcgacgacgtctgccacattcgcagctgccatcgcttcgacggtgggataccgctcgaagacgcggaaaaggaccgggatggcaacgcctccgcgtgtccggttgaggaagatcgtcgcaagtaacaggcggaacggatcgtgggctagctgttcctggatcaagccaaacgattctgccgatatgggcgggaaggggagacacgactctgcgtcgccggacggtttgggaaagtagggtgagacttttggaagctttttgcgaagtttcttcgccggcggctgggcgaacttggttggtgtttgaggaacagaacttggatcatcatgctggtctggagtatcttgtgcaagaggagataagggaggacagtcggcagcgatggagctcacgtcgctgggaacgtcgcttagagaagaatcagaagacaatagcagatcaaggagggattgatcgacaccagcaggcgccgtagcaccgcaaaccggggcagtggtgatgtctttagcacccgtttctgctttggccagttcactcttttgcgttttctggtctggggaacaagcaaaatatttcgacatcacctcatcgccggccgtcacgccttgcgaatcatcggtgttcgaaaatccgacatgtccgcacgagccggagattgctcgtcttgcttcgtcgcgttggagttggtcgcctgtggccgtccatccgcctttgcagcacgttcctgcgcctttctctccctcagtctttctcgccgtcggacacgttttcgatgcgatcttgctttgatggtcgcttcgcgagcctccttactttttgcagtgtctgcctcgctgcgtttgcctgtatctgctggttttgattgcttggggttctttttcctgccggaagggctgctggctgtggactttccttctttgcggttctttgcaaaatggtggctgactttggctggtcgtttagttttttgctttgtgggcttcttgcgattctccacgttaatgtcgccaggagctgcattttccttgttttctctgctctcaggtgtatcattagtgttcagctctgaggtcttgctgagattcgcttgagaaaatgtgatagcttcttgagtaacctctatcaccggaatcgcgctggtagcatcagactccgtactcaaagccgcagcagatccgtcttcaacaggagactcgttttccagcatctgcttcagcttcttcgagttgctcttcgtcgcgccagaggagccacgttttcttctttctcgtttctttcgtttcacatgcccgtgatccccaccgatctcttcaacctcaaacgtagaaccatcatcgtagtgaacatttcccttgtacaatcccctgtatagcttcctcacatatctgatcacccgttgaatggcttcctcgtccagtccaacagtggcggcttccgcgcgaagatcctgtgtgaatttgtgccattcctgacgtcgcacgaccggaccttcgttcacaatgaagggatggtttgcaatgtatcgtgtgaggcgatcgcgatgctccgggtccagcgtggaaaataagctggcttcttcgagcaaggtgggatcgacattgtcagcggtgtcagggctggtacctagcgttgagacatcgacagcgtcatgactggcttgctttgtggaggtctcctcgttcagtgtcaacaaacggggaagggagacttgtggagcaaaagtacggtccttgtcacataccccctgactcgcatggggattgttctctggcatcttgtcgcagtcagttggagaacatttcagaagtctcagcccagtcaagttggtgtaaaaaggagactcggcccaccttaggtgtggtcgctcattgtgaaccaacgaagcggggtggctcgaccatcacctccaatccaaagtcaaggcaagttccgactagagaccaacagggctcatggtatccaaaatgccggaagcaagcggtgaccacaagctttggagatggcgcgaagtgaagctttggttgcagctagctaagccaagctttttccccgcgatgttccgtccggggtcaggcacgcgccgaccaatcatatctactttggaaccacgtacataaaaaggagtgacaacaaccagatttttccggaaagctctactgaagacaagctatttggctaataactagaaggcttacttgactaagagacgatcggatgtcgggaaaggaaacgtaatagcatctctttggtggaacaggagagtatgaatcgtgtaaattgcaatttccccccttgttgttcttttcatctcttcctttacactttcacttctttcccttaagcgaaaacgaaatccacttccgattaggatcgtcgagggcctgcgcatgacgtgttgaatagcatccctcgggtggagcaggagggtatgaatactccgcaggcctaaatgtcgcgggcacctcctggtcgtaaagatcacgagtatcgctcctcggatccttgatatcagcagcatcagaggatgtcagtcatctgtctcaggttgaatggtgggttgggtcagttttgaggcacttacgaggcatatccagcatgggtattgtatgctcgcaatgcatttgcgtggtctcggtatgcatctcgggcaaatttccagtgctgtttttgttccctgaccgtggtctgggctacagtcaagcagcctgcgaaactcaagaagaagaacctctttgcgcagcattcgtcctcgccatcctcgtctgccagggacaagtccaagggtctcggccggtccttctctgtgaaacataacaagcccagttcatttgctcaacaccagcagcagcagttcgtcgaccgtaggcgtccatcggaaccatatctaggtttcagacaagagcatggagtaggagagctccactccaatccgctgatgcagcagaacacagagctcgatcccacttccaacccctcgtacggcctccagccggccgccgatccctcctcgcagcatcaatactctcatcctccgccgcattcgccgctcgaacatcctccctccatccagcgcgtcaacaccgatccgctggacgcgacacccttccaccacgatcgacgaggagagagtggtgacctgaccccaagccaggtgagctcccaccagcaccgcatgccttcatactgtgaggaactgcaaccaccatcgccccttcatccgtctttccaacgcgacccttcttccctctcgcaccatcccgtccaccagcattccaatctctcggaaccagtcttatggcaccgacgttcccctcaaccggagtccagttactcgccggcccggccgtcgtcgcagcagttcctggaaccgtcttcttctcccctccctccgcagcagacacaccattctgatctcatgatgaaactgcagagtccttcgcgccggccgtcccagcaaccttcgaacctcaacccgcagtctggcgacatggccgctgcggaccgtgcctcggggttacgacagccgcaggcggattcctcaagccagccgcagagcttccggcgagattctcaggctgcccagggtcattccccgtacccgggcactccaccgggcgccagcttcaagggcaattcgtcccagcagaacctccaggagcatcaacaagggcgggagactccgccatcggcccagcaaagcaagtcgcgagaggacctggaggaagtagatgtagcggcgctgatccaaaagcatgaagagctccgtatgtccagaacttctcatgtccgtgctgtagaactttcactaagacctgactgcagaggccaagtataacaaggtcaagagatactattttgaaaaggaggcccaggtgcaacaattgcagaatacggtggcccatcagcggatggcagtgtcgcgcacggtcttggatgataacgagtacacagcacggttcaatcgccttgatggagccatcaaggatctctcgttttctatccgcaaggagtggcagagcatccccaactggctgcagtcgtacgtcaacgaggacgcggtcaccgtgggcaccaaggaaatgactgccgtgggacgcgccgtgatctctcgatggctggttgatgaaatctttgaccgtctctttcacccggatttggaacccaatttaagtatacaactcaagatgatcgagacaaacctacgacgacaacagcctcaggctgctacggaagaggacaaggagaatcagatcgcgcgcatctccaactggcggcgagcgactctggacggtcttacggaggtgttacaatcgaagtcggcacaggaccaccgctcccagctgacggagggtctcattgaaaagctcattgcaagcttggggatgagtctgaaagatcccccgccgccggagatcgagcacggggcgaggatgattattgagaatgcgctgaacatcgcagagaagatccccctggaagctcgagatatctgcgtggagtattttatgcccgggacgacggtcacggaatcggtgatgaaggtcgaaacgggactgcccgctctgaaccgtccgggtgccgctgggtcgcctccgagtcaggaacaacaacgctctgaacgacccagacgggatagttcggaggacgtagatatggacagagacgccgtgaaggaatcctccaccgctcccaccaccaccaccaccaccaccaccaccaccaccactgggtccccgtcgagggatgcttcccctccgcagacgcaacccagtctgcccgcaaaccgggagcaaaggaagaagtacgtgtttgggaatttcatgagcaaaaagtcgtcgtcctcgtcgtcctcgtcgccaagcgcgggcagcagccctggctcgcagcagcaggactctacacgacccggctcagcggccgccaaagaccgggaccgggacgaggccgagaaacaacaagagagcagcagcggcagcagcagcagccgctcgccaacgcgaatccggtttgcggcattcatggcggtcgaagtccgggggaagggtccgaacaatgtgctgatcaaagctcctgtgtatgcgttggatgggtagtcttcttcctttttttttcctgtccttttttttttggatctggtgcctgtttatttgtttgtttggcaagagcagaatacaatacccccttcgttcatcgttcgttggtccgtcctatggcttttggtctgactgtggaggatttaatcttttcgttagtctttcgtttctcgtgttgtgtctttgactagagatgacatgttatggatatagcggtgattgatgacacaatgattttttatttgttgacccggactgcaggtgaactgcacagggaacgaaaaaaaagatttcttgtagatgaaatgggaggataagataagcctgtctgcctgcaggtatgttgataagaatgagtgaatgaaacgatatgatatgatcaaggaaggagctacgataattgcaatatattgcaggaacgaacttatatctcagtggaaaatacatgtcaacatctcatcacggaaacattcacaactcgttcgtgttgtctcatatatatatccataaaccgaagatggtgttcgatagaccatcgacaagcatcctcgcatgacgtatcagcataaggtcaatacctaggaagtgccgcgttatacactctacagaaccacctgcgcatcgccagcagcgtcatcgacaatcatacccaggcggagcgcccaatccttgcgcttcgtctcctgcaccagctcgtccgccaggttgcgcctgcgggcgtactttctaggcgggcccttgacggtgataaccctgccatgcatgtgcatttccttggtcgtgccattcgtcacggacagcagtcccgcagagacgatcagcagaagcagaaggagcagctggccgaacttgctgacgttgctgaccagagtcgtgtcgaggtacaccagcagcgtcgccagagcggtcaggatgtcctctgcaaacgtccggtcgcgcatccactgcccggacgtgacggccttgaggtcgtcgacggcaccctgcagccgcacccagcggtcctggctcagcagcacgaggagatcgccccggacgcccggctcggaggcgcctttccagcctacttcgcggcatcgctggcggatcaccacgacattgcacagacgcgccaccatcagcacgagcagcgagaagacgccccaccagtctcccatgacgatgaaaaccaccagcagcgctggagacgcactggccgcgcagatgtaggccgcagacgaaatccagtctgagcgggtggccttgggatggtggcgatgtgacaacagccgtgagagacgtctggcaccagaactcaggattactgacggggtgaacttcttcttgtatccctgttctctactataccaactccccttctgacggctttgcgttgtcctctcctctggcgacgtcaaaggagacacttcgagccgcgtcaaatggcctgtctccgagaccttctgcagaaacatcaccgttgcgggattttcgatgcgaaagacgtatccggtcgtcatggccgccgccgcgggatattcgccgccgttcagctccggtgcagactgctgtcgatgcagaccgggacataggaccagcgcatcccagatcaccgatgtcccggtgagagcagtgcgtttcgccactgctgttatctcggcgattgctacgaggccggccgcgtcgagggatacgtttgagagtgcgtttccctggaagtttaggtccagtagccggcgttgaagctggccggaagattgcgttgcctgggagaaagaatattgtgttagcagtggtgatctaggtaagtaggtcctcgctttctttctctctctctctctctctcttgttttttttttctttcagattcgtttttctgacatttccgtttgaacgtttctttttctcttgtctcgtaaagagatttcatcgcttacattgattggaatatacatctccctcagttaacgagtgctctctaggtgagttgaataaaattggatactattatttctgcgtggatatcaggttgtctgtcaaaggagcatatcagagggcgcatagcctcaacttggacaattataatgctggcaaggcacttttcttcactgttcgattggaagaaaagaatctacggagtgagcccacgacaaagcatcgtgatgcgcccgggcgactcctcgtgatgacagctgtttgcactgccccgctcccgatgcccatgtctcttctcttgatgcgatttgctggggagacagacagaaatcatcgacctccagtttgcatcgatgcatcgagactcttcactcttctccgaaacgatattctagcgcatgcgaaatatccatgaaactggcttatattgcggttattttcattttttacagtatcctttgccccttttacgttcttgaaggctggttgttgctgacagtttgatcagtgccaggcaaacaaggctacgaggctgaacgcgccataggcgagttaagcggcgcagaagcgggcgaaaacccaacattgttatccctagtggctcaacatgtatgatcattactgggaaagttcaactgcagggctgggctgccagcagctggattaattagattctttagtaccgactcgtcgctgaatgatgccattggttagcctcgtggtgttgcggctgatatgctgtcagcagcgaaaaaaaggcccgccgacagccttgttgagtaaatgactatgggcgaaaaaaagagcaaggcgattttattaaacagccttgcttctgtcgtctcaaggacttctctgcagcaatgattgccctcagtgcttacttcgcagggaccctctcgtgcgaacttgacatttatgaccaaaggtgagaagacatcgatgttgaaaccggcatgaattaatggtttgaagattacatcaggggtggaaatgtccacataccagtacacgcagttgcagtcaggcgaattccgcctcttgaagctctcaccgggagacgggaatacagagctggtgggcgctctggagatctataccctttaccccctagcataccctccagaaaacaatcgaagtccggatccgaagccatacgatgctctctcttacacatgggaagatgacgagatcggccattccatcggactgttgcgtgaatccatagcttatccggtgcccatacgacccaacctgaaggctgctctactacagctgcgagatccaaaggagccccgatatctctgggtcgatgcactgtgcatcaaccaacgtgacaacaaggagaagagtgaacaaatcccgtggatgttccacatcttcagcagggcgaggagcgtctgcgtgtggctcgggcgtgaagagggggacggtggaagagcgatggacttcatccgaagactgatatcgatatctgacgatttcgatcacctggtggcagaccacaatctatccaaagactatgtggcgctgtcgaacttgctgaagcgaccctggttcagccgccgttggattgtccaggagattgcgctggccaagagtgcgactttgcactgtggcaaggagtccatctcctgggaggattttgccgatgctgtatcgcttttcgtcaacgcacagcccaagatccagaccgtgtttcgtaactcgcacgagtttcataacgatcccgattacctcggtgatctcgcggaatatgccggtgcccgcctggtccaggtcgcggacgacatcttccgaaagacggaggatggccgaatcatggtgcggttgctgtcgttggaagagctcatgtcgacgctgtcaggattcgtgaccacggatcctcgtgacgtgctatacgcgatcctttcgctcgcacgggatgcgcgaccgggatcgaaagacgcattcatctcccaagttggagatggtcttgagcaacaaggaaaccattcgtcgaatgggccacctgtatctccaatttctcctatgtcttatgtccagaacgagcagtggtcagggctgactccagccatggcccttaggggtggtggccaggcgccaagatcaagagcatcatcggacgcccgatccgacaacttaagcaccgtgtctgctcctggcccggccggcctcgcagtccctgtacgtggcaggggaagagcttattcggatgccgagtccattggaactgcagctgaaaggcaacataatcagcagagcggctctgaccaaggccaggtacctgtcgttgtgcaccccgctgcggacgttaatggaggaggcgtagtggtcccaaatgatgccgattcacacgatactgcggaatatactcctggtggtgagcgggtgaatgggcaagacatcaacagtccgccaccgaggcgtcctcaactatcgattgatcctgtgtacaatgagctggcgaaaaagttcataaggacactccgccagcaaacgatactccaccggatccctgttgattatgacaagaacatcgtcgaagtctgtcgggacgtcttgttcttcaccgtctccacttcgggttcgctcaacatgctctgtcgcccctgggcgccggcggacgagtcgctgccatcgtggattgcacccatcagccggaacccgtttggacttgggaagaatggcgtctaccatcgggtcaacgcggatccgctcgttggccagccaggcccggggcggagtttctacaacgcggcgaagacgacgcccgcaatggtcaaaccaaaccccaagataatgaccagtctggttgcctatgggtttgtcctgggcgctgtcaaggagaagaaattgcctgctctggcgggtgtgatcccggcagaatggaacgaggtcgtcggttggaaggacacctccaagccgcccccggaagggttttggcgcacgctggtcgggaatcgcgactcgtcgggtcgactgccgacacgactgtggaagaacgcatgccaaaaggcattcgagctccgacccaaggggggcgatctggtcgtgaaagaggtcatcacgtacaagtcgcccgagtttgtcaagaaatatctggaacgcgtcctgcagacggtgtggtctcggcggctagccttcttggagaacagtcgtgggaagcggacgctgtgtcttgcgccacgggaggcgaagaagggcgacaaagtgtgcatcctgtatggatgcagtgtgcctgtcctgctccgcgaatgcagggaagagcggcaggctatgattactgccaaccatgacggcgagacgaacccaagcgccagtgcaagaaggacgtccgcagtcgaggcgcgtgtcacctacaaggtgatcggtgaatgctacgtgcatggcatgatggatggcgaggctattgcataccaacaacaaaagaagatagagcaccagcattttgatctgaggtaggagtaagcaattaatcaggtttataagtgacaatgtcattcttaagtgtagtagaagaattgtcgaaaaaaggaataaaataaaaagtttaaatctgttcattctacctatatatggaaggtggatggtatcattgcagaaaaaggtacattattaggataggattctacaatcatgtcacttttttattaataaattctataaaatagatatttccttttgtactaaatacagtacatactgtgtatgttcatgttaagataatgaaaagaaggattcatctggaatatggcacaatatgatacataagaaactgcatgaggaggcctttgctgtattactctaactattaatatctactccttgaggcatgctcggtaaaccagggcataggccgccaaattatggactcgacatcgccaaagtccttccctttgccaaaacacagctcccttccctgcaggatcgatcaacattcagagagtataagtatagtggcccttgaggaaattatcgcagcagcaagccacaggcgggtatgtacctgtcttttatcagttgcttattttattttaattctatttaaccatagttgtatgtataaggtagtgttaggcttataaaatagctccctaattacccttctcaatagaaaacataccccttattaactttagtaagtaataatactgatagctaaatagattattaaagctcttacttactataataagtatataaattagagccacagatagcagaggtcttatatataagggattacctgacagtcttttaactactataaacaatcagacggcaagaggactgccaaaaacggccgcagtcgtcgctgttttcagccgccgatttgccattcttcctgccactcactcgtccgcctgcctccacgcaccgcatccgcgatgctgacctaagccgactggactcttgccctaagttgaatctcttccattactctgcctctatcgcttcgcttgtctactcgaggggagccaaaaacgacctccctcgacccgttacccttgtccttggccacgctcgctccgttacaaatagtggtgtttcccttccctgcaagatgaagcctcctcacccatcccccagccgacggtctcaccaccttttcagaggcgtgtggaccggcaaccttccaaatctatcttctttcgattcatatatatattgtgttattcgcttcgtgacatttgtgcaatatggcccaccgccgtcggaaggccgactaccagtcgactgatgagagcggctattctgatggtgacagctccgacgacatgggatatgatacggacccaactgaacttgacgaaggtgaagatcagctgagggatgccagcgacgtggcccagctctttggggataatgagcacccgccagagtactatatccaacaactcgagaacttcgatgagaccgtctacacccaggaagactacagtgaagcactctccttctgctgatcgggtgtgactttttccagctctgctggggttctccgtgatgtctgacaccgttgctgattctgactggtctatgtaggtgatccggaaattggctaagaaacacaaactgtccagtaaaggtcgtgaaaagtcggctatgtatgtcgaggatctggcgaaggttgtggagactgtcatcagcaccacaaaaaagaagtttggacaccgtcaacatcgcatcgagctctgtctgtttctacagctggcaggtcttacaacaaatcgtccgcaggccatcttggatctcaagtatcgccatattaaagtctgactgctccgagatcctaaaggtggtcctcatcggatcgtgatcgagttcacttttgagttcacgaaggagtttctgggcgccaaagacgagtaagtggtacctggcgagtccgatgaagactccatttctatttatcaccgcagcaaggtttgaccttggactaggaatacctttattctcccggaaatcatcttcgacccatcactcatccttagtccgcacgttttcctgttaggtcttctcttcgccgatcgcgcctttgcacgtgttgatggagaggaagtgctgatgtctgcggagcaactcctccgcctgcggatccccgatgaatgcaacgagctgcaattgacgcttgaccccgcgttggataatatcccggtcttccgtcagtcagagcgcacgctggagggaatcactatctctcttgataaggctctgccctactccacccttttaccatgggtcaagaaggtaggcgcaattaccggcttccggcaggtctcccgcccgtacagtctgcggtatggagccggcaaggcactggataatagcggttcgttgctcttttgactgatatgtcccctgcgatctcaacgtcactgaccgtttggccacaggatccgtcagcgatgctctccgcaacctgatcatgcaccatgccgatacccgcaccttcttgaagtactaccttcaccggaggatcgacaaggacctcgcagccatcatccgaggtctcgatccccaggaggatatgatgcgtgcggcctgtcgtatgagccggacaattgatcctaagcggccgcaggagttgacgaccgcgcaatcatcctctgtcaaccaacagcctgaaattcaggatctgatccaatggcgcggtgagctccgccgacagctgggacgtccgctggcgcggcaccgtggaacagtgaagtacgaggtgtatcagaagcttaaccaggaattagctggcgccaggcaacgggcgcgggatgcgctgcttgcccagcttcaagagaagtatgaccgagagcaaccaatgctggaaatccagcggcagctgtctgggaccaagctggccgagaccgtgaaccagacactggattattgcgaagaactgcccgctccgcagaaacgtctgattgaaactattttactctgccacgatcgacactggaggacgagatgcgccgacggaccgatgctattgacgccattgccgcttactgtctattcgaggaaggggtcacatgccgtctcgcacgggacaaacgtcccactggccagatggtcgaggcaacaaagccagaaggatacgacgttaaagaccaggagactaatgctgccgaaagctgctcccagtcggatcagctgctggaggcagctattcgatcggtcatgacagagagaaggccccgtgtctgtttcatctgtgtgggacagccgaatttggacatcaaaaagcgcatgaagcaattcaaagagcacggtgacctaaccaagcacatcagacggaagcatttcaaacgagccaagatgggagatccctttaggtgcactgtctgcggcctgcagttcactgataagatgcatcttcaacgtcatgccattgatatccattcgactgtgacatgattcattttccatctctccgccttcattcctacaagctctatttagcacgatggttaatgtatctatcaattgcacagatatcatgtacaggacctttcccacagcccagttcatttacatcaaatgcatcatttctctactgctctcttgcctgcctgctcattattgatcagaagtcagggctgcatcctggccaatgatgtggctaattgatttgacaatgaatagagatgcataataacattcaacactgtcctcagcacaatgcagaagttatcctggacagcgcctggatacacctcctagtctgtcagatgaggatgttaagctgctgggcaataagtctgtcacttccttgcattcacaactgccagatgttcacgaaggctgtgccccaacacctattgcagttcctgatagtaaaattgctgagaagtctgagatcttttcaaagaagaagaacaagaagtctaaaagtctaaaatattggtgttgagttgttgtgaacaaatgtaatttttctactctaatgtgatgttgtagtgatgagtgaggcaatagagaaagatcaaaagaagtccgttctgttttcagtatttggtgaaagaaaagaaaagaaatgtcatgatcatcaaaagggagctgacgtctgttaaataggagagttgattttgccttaggagtagacaaaagtctcgatcgacatcaacaagggccgtcatacagcatgaactcgatataatcctggccagatgaacaatagtgataatcatgacattcaataatctacaaccgtaaggccacaatgcggagtctcatgtggacttatcaaccccaggtagcataacagctcagtattatggagtatttgacaaagtgctctgataaaattgttgaggttatggctataagcatgtgggggagaagcttctacaagctcactatagaagacaatataatgatatgaaagaacttttttttcttgattctaatcagatgtgggcgacctggcgtataagccttattgtaagaagcggggtatcggcttccaatatgatgtctatcacatcagcttatatgactaccgaatccagttagaccggtatgccaaaaattcaggctcaggcaggatgtgtaaagcccgacagcattgttatgtcatccccctggagatagttgattggactgcccatcactaaatgaccatcgggaatgacaatccagagagcgaatgagctggatcctttaaccgccgaggtagtcgccaaccattagagtcggttatgtgtacggacaacagagtgcctattgcattagtccaccaaacaaggcacaaatctggatttcatcaggtcgcctactaggagagccgaacttggtcgtgcctgctttcacagggttctgactccgagacaatgggcacaaagtgttgtgtggagatcgaaacgcctgagggccattgaacggccagaatgtacactgggattggcaattttgtaacctggccgtggcggaggtttcatcaacgattctcgaaagccactcgattggttgatgggtgagggaggtagtgacactccgaccgggcgcgaagacgagcttctaaggaggtacgaacacaatgctgcagcataaaaaggtacccaattccctcaacttatggcttctctagctgatttcacagagtcttcgtcaatcatcgagtgtttgatattcatcatttccgggtacattatacaagaaagctcctttcagtccctctagtccctcgtctaaaaaaatgagccgcaccttcgctaggggacttcaaaccacctccagggcgcttgtccagtttactggcaccgttagtcctaatgacattctggccagcaatggccctgcaggcggggcatgggaagcggcgaccaagaaagtatgcgatgcgatagagaaggctgtatgttaaaaaaaaaggttttttttaagtcattcgtactggtgctaacatctgctcaggatccacgaatttcaatggccaatatccagtatggcgttgcctctaccgcccctatttcagttaaatttaccaaactgttaacgtggttttctaggggggccagagcacacttgtcctccaaggataggagtgatcgtcagctggtcatcacggtaggcctcgctacgaactctgggacacgagtcggttcagtccatgtgcatgtcgatggtacctttaaattctttccctctcgtgctggaagggagggtggatacgaagacaatattctgcgtgctaatattgagggacacatccaaaatttgggaaacgagccttctgatgaagccattgagagaagtccagcaaggggcaacgagtaagctcaaaggataatggacgtggatgtggttatcatgtactgcacgtgtggctgcgaaatcgcttaacctgtgtgaagcatgggtgatctatgtattggatagttgtcttgaaaattgctcgctttctctgagtatcctctgggcatcctctgtttggttctgtttgcattgcttttctcacattgcatttgagtgtccatagttcttgcctgttacgaatgttatactgtctcatctcatacagcaattgttgacgtggtgaggcccagaaactaccagtagaaactttgtcttctgtggtggtaaaatacctctgagtatctgttctacctagcgtgcgcctaaagatctcctgttcgcccattagacatttcaattgggtgagacttcctaaactcttctccattggttttccatccatgatactcttgctagttagtagttaagggaaatccgctcgggcatcgtgccgcgcccaggacccagtaccatagcgggttcagagttagtggctgccaagcattttagccccatcgtgatacatcactcagctggactcttcagtcaaccgcgacgttgcgttttataatctctagtaatcagtgcatctatttgcggcctttctttgagaatgactcgagcctggcgatacacccgcggcatttttgtgtctcgtgacaatttaaaaatccattcctgcccgcccgtgaggtcgtgctttcgccttcaaccaagttctcaatcgccacctttctcgaacactaatcgcagaacaatgtcgtcatcttctttgggagtgcctcatgccctacggtcgtttccaagctctggctttgagttgattgatcactctgaaaagattgaagaggagacactacctacttaccacgccgaaaagtactatccggttcacattggggaggtgttgaacaaccaatatcaggtgcttgcgaagctaggatacgcgtcacatctacagttgtttgctgataaagtcgaacctgaaaaaaagaaagtccaaagcatgttcggcgagattatcccgtctgaaagtgaattgagacgggctgctcagtggctttggtcttgctacgaatggtaggctcgagtacacgacgctgccatcaggcattcatctagagaatgaccagggaatgctctatataacaatgagacggtcagcgagcggccaaaaacggccgcacttgacgccgttttcctgagtcctgctaactatctgggtcttgcgagtccagtgcacgaatactcacggcgtccccatccttaactccacacacgcccctggttgggcatgctgtggtccctggcctgaactcatgctgctcacgcgcggctgcttcctcgatcaatactgccatcacctcgacttgcagcagagcatcgaggtcactttttggagggagccgtttctggctcccctcacatccccctttcgctgtgattctataagagtcccatgacggccatgcgatgtttaaactcatttccctcgcttcagagcgattgccgtgcattgtcgtcgtcgtccatcccaatcacctactaccatccacccaggcattgtgcagctttcaggtcaaaatgaattttttttctcttttttgtttctctctttttgcctggtttttgatcatgcatcgtcgctcccaatttgatcaggatgtcacgtcggacgagcagagccatgccagtgctgaactccccgacatcttctcgaacagtcctccgtccgatggttcctccgacagtgagacggagccagacagcgacgagtcggatgatgatgatgacaacgacgatgacgactcgcttttcgacaatgaagagcagcatccaccggaatactatctcgcagaggctgagtgtcttgatgtctcccagctccgacagcaacgttacagtcccaagactcggaagaagctggaggatacaggcgtcatgctacagccaagctaacatgcttcaccttgtgtctggccagatactgtcagttccaaggacgtgatccagttgaacgcttccactctctgcaaccgatgagactgtccggtacctcaaaagcttgtcagctggtgttgtgaccaacggcggcggggcaagaaccgacactgaagtcctggaatcaagcagaagagctcgttagagaccttctagacgtggtggcatctggtctacaagagtgtaacagggcacggctcaacaaaatgacaaccataaagattgaggatgtgagcagacggttttttatcatccaacatttggccttggttgatgagctgttacgtgctcgcgatcatcacagaagaaaagagtctcctacctgaacgctgaccaaaagtgaccatgtatatgaggatgttgcagagtttgctcgggtgcttcttgcaaccacagagatgatcttttctagtggctggctccggactgagctgattctcttctgtcagcttgctgctatcactggaagccggccacaggcgctgttggatcttcactaccgacacctcaagttcattctcattcgtgatccagatggcaggcgtcctcgactatttatttacctgaagcctgagttcaccaagacatttctgggcagggagccgtgtgtttcccctaactttccccatctatgcaggggctaatattttcgctctgcatgcaaccaccagtccgcaagctgcggcaagatgaaccattgtatttaaggattcaagcaaatgatgagtcgatccatccagagacgacatttctctgcaaaatttgtcgctgggtgacgaatgccctagttaacaatgtttagaagcacattacaggtggttcatagctgtacgaaagcatcctaaatgtggctgcccaaaacagcgagtaataggcgcaggctaattcggaatacttcttgggtcaactgcttgggagtgtcctaggttatccatactgtatcctaaggacctgaacaatggagttaaaaaaaaaacaatgagcagtacgtacaatccccttcaaccatcgcactggaactaggacatcaacggaaaccggggaacaagtaatctgttagaggagtctaagacctcaaccgaagaaaaatcattcgcgaacacagctctccaaagcttggtaccagggacatctacccttgaattagcagtgcaagccgagcagggagtaaacttactataagggtgaggaggcgaagtacgacagtcgatgataagccaatcccggagccagccactccggatccactgcatataacttccattgcccacaaatctctgacagtgcgctcccaatctgttaccctcgcgcaacaattctatgccccatccaacgtctgcaagtctgaagtcgattctgccattcccatctcctgaccattcactggacacttttgttgagaacccgagaactgcatgtaatgcacgacaaaattcgtcttgataggcagcttcaacaggccgtataacggctccagtaccaacccgtgttgtggaagaaaggtttctcaacgaaaacttcctcaataccgcttcagctaaagcctcgacagtggggtattgattcatgggaaagggaacagatgaatcagtaagataatgctccacgtatctgttcagatcagcagagtctaaacatagtgaaaacaaggacgcccactttgcatgcagtctcgttggaaagacacagacaatattaatagcgtcgaaatccaacggttcagagtgaagccacccattctcataacaggttatgatcccttcattatccaggtctcgatggatgctgccattcataagaacttctcggagaacacctgctgcttgaggggtaagttttcgtcggcttacaaaagaccgttggatccccgtctgagcaagatatctgaaggactcatcttcgtcatttagggttgcaataatatgatccttttcaaccacctgaatctccccatgtttaatttctgaccgataaacctgcaacgcattccataagcaattagtgagctaggacagaaataaacgtcaggactgaccttctgtatcatgccaaggacactgtccacagcccccggatgtccgttagtcaggctgaaaatgtagtcagctgcgtcagggtgcagcggtagaggacgccgactatcagtacatatccgttgtagaacgtcgtcgaattcgttgcggttatagaaaaggcttatcggtggtgaatctttgatctttgatacggtgatggatactcgctgctgaacaccaagatatgcaagtgggctaccagcgctgtagtcgttaggacccccagtaggactgccatacgaagtgaacacacaaactctcggtccgaatcggcggttattctgagacttgatgaatcccaaccaaagaccggaatcatgatatgacatctgcccttcgtcgatgatgtagacaatgtctgcatttctgagagtatctgcagtgacaaaagtgtaacccgcatcctgtgcacggcgaatgaggacatcagtgtgcacatgatcattcccctgtggccaatctgaaattatgactgatggtatgttttgctgacgataatgctcgtggagaagataggcaagcgtggtctttccagaggcgggtgtccctctgacgtgggctaccctctcatcatcgagtatcctggcgagctctgaacagtgtcatttcgtgggcacaggaatggatccgctacattatcagagtcagttacagtcagcaacgaagatgcggcgctgtccaaaaaggcaaagaggtaggcgtacccataacgcacgtggaaaggcgatttggaagattggaacttgctggctgaccagaagacaggcaagtgtcttgagctgtagctcctcgaccgataagtcttttcaaaaattccatcccggttagaaaattcaggagttggaagcacagtgatggtttatgggaaggtaggacgtagaaggaaagtcgaagtagggaaggtgcaggggcttgcatatagctacaaggacacccaaggaaacatgcggagaaaattgaacattagacgggtttgtctttggtcaagttgtatcaatacaatacaacaaattgccggtctgcaggggaatcgacaatggtcctggcgcgaacacttgcacgatgccggagacagcatcctctggcgcagaagaaggctagcggctatgcagcaaatccagtgtcatcctgttgtagtagtattctgccacggcagaatatcacgtgttcgcaggcggtgagctcgagaatgaggaaatattatggggggttttatcagcgagcgagcgcgccatccccgaacgggacacgctattcctgacatggaagtgctaaaccaagtcaggatgagctagagcctgtgacggcaggcagtgagcggccaatggacggtagccgtttccagcaccccgctaaccgtctcatcgtatactatatatagataaacgctttgtttaattcattttcgttttccaatttaatataattgcttatagcatgtacggaaatgtattcatgagaacaaacacatgacgtctctgtagggaagtatgtagatgaaaattcagataataattacatatcttgctttcagtgtccaagttacagtaaatggtgatactgtcactcatactgcatacaagacgctactcagaatgaggaggagttggggttaactaaggcaatatcgagaaaacaaacaatatcagagcatacggctatttcggctactcggaataccatggtttcaggttcattctgtttaacagctaaagcaatgtaccatacaagatcaatcattttcaatatcccacacaaacgagggttctgaacctcgaaccggttgtccgtctattccttcagtctgaggaacaaggcaagcgcattggcccggttgatctcgtgaatgagattgggattctgaaatttaaagctgtccagacccttggtgtggaaatccacaatcccgtcgtgcgcatacggcgtatcgctgccgtagaggatgtggcccggtttggcaaaagtctcgaggatgcggagcacattctcgctgcccgctacggcgaggtccctggtatacaacatttttttttctctctcttttcctcatctattttatcatcatattattatacttcatgatacgtcctctcgctctccctgttttcctcttcctcttgctaactatgtatataagacaccttctttaggtaattcgatcacataccataaaagtacgacagatagcgaccatggttactaaatactatgtagagtacatagacagttatctgtgaaattgcacattgcacatgggagtctttagcacgattttaagctcaagcttgccattcgaccaggcacttggatccatgtcataaggacaccgcatgcgaatgggaattcaaatatggagaagatgtggacgtacgaatatttgcagataacttctcttggcatcttctggtaagtcactacgtctctcattatattaccgacgaaccgccatctccacgatcacagtggtacaaaattggttgccgtaatcagcgctgcagttcagtattgctttcctttttatagatcacatccatgtgacctgctgaaatgctgtgctcatttttgcctttatgccaagacgatgattttattatttacataccttacaaaaaagatctgttatcatagttgcagaacatgaggtcagattagtttcctgaagtagtatattatgcagataaaccctggcctatgtactatgctaaaataaatactgccaggatctgctgacatgcattcatggcaaggtcttatataaggcttgcttttctaattggcctaatggcttatagacttatgtctatattttgactagtcttgacattaaaagaaagtagttagtaggaggcaatatgcccagtaagctgcaggagagtgttaacttagggcttaaaaatataacaggggaatgttaattattctctcccttataggcttagtatttttagaaaggattacatttaagctttttaaaaacagtctagaaggacaacagacaataatcttctcttctaatcatctattagccaacccggtagtcaggtggtgaagtggctgccatggtgccagggctggtctccaaccagctaggtgcgggttcgaagttggcataattaatttcacccacccagcctaggtgtaaaattaggggcggatggtaagctcatgcctcaactaagctacttgtactatagttatagagcataatacttaggggcttagctctaggccttataggtatgactataactataatatagggcaccaattcagggaaaaggatttaaaaaccacccgattagggcaccctgggtagctgagacatccctatagagcccataaggggagggagcagctactggatagttcctagggcttaggctctaggggcaagaccatgacggctaataggtaggctgtgatgccgatattagcaactggaagcctggagataggcagcctgggtacgccttacctagtggtgacctgctaggggcctaggaggtgcccctactaccccccttaggggcccatagggggggtagcctataggggtgggaataggtggctggctaaggaagggtgggcagtggtagtatagtgggaacataatttcatccaatacaactcgttactaagatacttactctgggggtcagtaagacttcttactactagtggtatacttcagtatagctctagtaggcgttgcctctgacctagtcgttgttgctatttctatcttggagtaacctcacttgttgtgtatccctgcaagacccctatcatacctgcgagaaggtcgttcgaggaagagcccttcgccagctaggccgttgtctcaaggagaggagacccgggtcagtccgaccgtcgcgtgctcgtgaacgacatagagtcaggaagactccttgatccttccctaaccaccactgttaagtatccacgactacggttggacccagcacgtaacacttgcacagactgctgagtctgggatggtggctgctggttgcagtttggggtcaacatggttactgataatacttgatcattcagtaaccagggtcaagacggcgctcaatttgttacgcactgggtccaactgtacggttggacccagcgcgtaacactcccctttgtgttttttttttctgttctttctctcgtttctttgtctttgttaaatccacctatacctactattccttaacatttgatttctttacattatactactgcctgtcttctcattccctatttctgtccctcatagaaggttcccactgttgactggtctatagcatcacccacctgtatatagatattagctactaagccctactgcctaggtggtaggcagagcgtgcatagtctctgactgaaaacgctctctaaaatggaagaagaataataataatctatagagcagtggctactaacactccaataattagtatattgttggagcctgaggctctaaggcctagtcttagattgcctcactgcctgcactaagtcatatcttagtttctgccgctaggtatcagatagagagttaagctgttcttcatctctctgggaggcatcagagtattaggttatgggcctagggtgtcctttttgaagccaaatacgtgctttaaccctcgtggaacagcttcatcatctttaaacgcgcttattaattgtgtaacatgcattcagcattaatatcattaaaatggtgacccaaattaatggcattccagctaaaacagtgatcagcctcaagagtctgcctaagaaactcaaaggatctgagaattatacatcatagaatatatatgttaaaaagatgctcaagatagaggatttagacacattgattaactcatctattccttagccctctgcaaattatctgaattatagcttgtggaggcaaacttcaataaagataggcatgtagcttgtcaaatagcttgatgccagacttgtagagaagctagatctatctcccaaaaaggagatagatagataattttccatcgcatctctggaacaatgccagtttactttaatttcagttttgtcgatggaacgaatgtatgtatgagatgattagttaatatatagcttgaattcgtgatcataattcaggtaaaaaactaactggtcattccattcatcccacctatcctatgctagatatatcccggggtatcaaagtcattaataatctaatgaaatgtactgtacagtcatccacgcaacccttcaaaacaaccaaacccagacatacttcccacgccaagccaaggtataaaaataaaaaaatatatcgagaacttaaaagtacacacaccaaaccagctgggccaatctgtcccgttcactccgtgtccgacccgtaatttaccaacgccgttgataatgctggtgttgctttcgtcgttgttgtcgttgtcgtcgtcgtcgtcgcagcctgacctgcaggcgcttgtttttcgtctggtacttccactgccgctgcctctgccaggggattttgctcgggggttgaggttgcagtctctccatttccatcaccatcaggctcagcttggacctgatcccggggtgtcgtctgagtcttgcgcgttttcagcagtgctggttgccaggtgatttggccctcgttgagaaacgggtctagcgcggcgcgggtgttccctcgaagctcgctgctcagcagagcttttctttccgcggcaagagcctccgatttcagtcgcttcccgcttcctccacgcttgttgtcgcgggaagatgacggtgaccgggacgacgtcgtttcgaacatcggcttcaagcgactcgccctggcggaatcgtcggaagaagcggaaccgaactgcacgagaccggcgcgcacgcgatcctcctccatttcttcgagcaggtcgatacccagactcatcttgtccttcagcgcttcgttggctgcgtccgctctctcgagccgcttgcgctcctcgcggaaggccctccgcagtcgcttcgacttctcgtatggatcctcccaatcccggtcctggcgtttctgcagctcctcaatccgacttttcgctgtctcgaactgcttctggtcttggactttgccctcgagacgcgcgaaggcgtctttctccgcctcgtcccccggcccaagacggatagggatctcgcccggctcaccggtgagcttgtcctcgcccgtgtcgcgcttcctcccgccttccgtgacgacatacgcggtgttcttcgggtcggtgcgaatctcgatccatccgccgcagagcgtgtgtttcatgcgaaagctgtagatgggcgtggaatagtagttgccgacgcgcttcttctcggcgttgaagcggactccctggccgatgagcacctcattgggcttgcagttggtgcaccagatcgcaaagggcatctcgaagcgcacgatcagggcgcctttcgtgtggaggtggcgcgcgcgcgcaccaagagggtgtttcccggcgagcttgttgcccgtcgtgagaccctcctggtcggggggggacataactagaagattgtcagatggctgtctttgaaagagagtctgcttcgaaagctgcaacgtcaacacataccgtcccatatctggaagagaaatcgatgttagcaagaagacccgaagtgcaagacggcaaagatgggaaagaacttactgaagccctgcattgtggctgaacgatctggaaatcaccctgtatcaaacatgtgaaaaaagatgatatcctaagcaagagacactggatcactcggtctgtctgtaccgtttccctggtctgaaagtgcatcgcagtccgagcgggacgtcgacgtccgccacgacaacactagtccgtattaggtatagcttcaccaggtacctcggtttccagttagtgtgatgccttaggcggtaaggcagcaacgagaccacttatgaccaatctttcggacgaagcacattggaaaatggagaatatgatgctgtggacctttggtcatacacatttcaactgcgatttcgtcgacctcaatactggaaagggagtagtggctaacagaaggcgctatattactgagcccaatctgcaggcttcaacaccagaaaggtcattcaaatctgaaccaacggcgaaaaaaaataccaataccatattgacgatgatgacaaaatttattcagtcagtgggcatgtaaaagctttctgttgattaggtcattgcgcagcccatccaggatggagaatacttggctatccccaatcttcagtgcacggaaaaaggatctatagcacaccgccaggtcttcttccttcatggcttctgttccatcaacatattcaattatatatgtcagtagcgacatccagtacatctcgtggcggctagctagatcccgacaaaggagagtgatgatagcctcagtgtagcgtggagctgtggggatccggacaggatgaaggtgcgacggaaaagcaccctgaccacgcccgagagacgcagacggaagtctagagtccgacgcaagcataatgttgggattttgggggtcagggaattcaagtccaaaatcgggaaacatccagagcacttgagacttttggtataacgatatcgtaaggttgtcatcaatatgtacgtgtactgctggaggcggagaaggcaaggacgggtcggatttggtacaattcaagccctgtgtacactgtcgaaagccagtagagaggagagtggagtaggccgttgacaagacgttgtctggcacaacaaaagcgaagccctgtcggagagttaaaaaaaatatatctctgtggcaattttaacctcaaataaaccaggaaaactaacatcaacaatggcagggactccgaaaaccgcgagcagataattcccccataggaggttgggaacattggcttcatcaagggcaccagcgacggccgcaacaagcttgttatccagtctctgattgtcaaatttgaaaccaggcatctttcgagtacatccaagctaggtcacaagaggagccagatcccacaagaagtgttttctcttgcgtggataggttaatgaaaagagactggagactcatgttggaagacaaaacctgcctgcagaatactactcatgtcatgtgatgcgcatgactgtatggtggtgatcgatcccatcattatttgcattgaatacagtaaagcaccaagacttgctccaggcccctgtagagtctgttcagagtgttcctggatgttacaaggcaaaagaatgcttgattggattacatggcctctcaggctataatactatatatgtgccaatttggctggcaacatgagggtaatacaaaacctaagaaggttatcttttaatacaagattcaatgaaaacttataggattcatctaactactctaactaggataactcttatgtttggcacattttgcagagtacaaaccctcatagtcggccatatttttcttttcaggcttgcgagataccacgtggttaatgttggaattcatggcataccggtctaactggattcggtagtcatataagctgatgtgatacatcatattggaagccgataccccgcttcttacaataaggcttatacgccaggtcgcccacatctgattagaattaggaataaagtctccttcatatcattatattgtcttctatagtgatgcttgtagaagcttctcccctacatgcttatagccataacctcaacagttaacacgcccacgtggttgactgtaccacgtggttagccagattcatggtctaccatagggctggtaaactcctatggttatctatgccttatggttggtcactttctacaagaactattgtctactttatggttagttattccctgtggtttagagtccctcatagccatgttcatgaaattgtagtaatcgtcatcagtccatatcaaggatccgatttaagcatagattcttcagtattgctgagcttgcagcaatttgcagctatatcagcacgcacagttacccctttaacacatctctttaatgttgttggagggacatcatatgctgaagctgccttagtaatcaacctaaaaaggcctttttataagtatcaagagctaattgtaaacgtccctccctagagacatcagtagtatcatgtttgagcagcattgtggtcaaaattgttggtatagaggcagttgaggtggttgagttgggggaccggaccgctcggtgtccgactacgttataaatttttattaagtctatagacatagctagtattatcctctagcctaattagttatttaatatagactttattattaatattattatataagaaggctatcttaatatctatctatttaatctcctagtctagtactattataataataaataaagccttataacttattagcttaataactaaagtaaatatcttattacaattaatcctttccttttatttaaagcctttaactatttatctagctttaaaccttaagatctctctatttagcccctacttaattttatatacttattttccccttaatactttactccctagtagtactataattaaggtctaagtctaatttttaaatagtaatctaaattctttttttattactttatagctacttttcttaattaggatcttcctaagcctctttaaatatcttaagtatctctactagcttaattactataggtaagaattaataaagtatttataggactattaaattactaattaagtatattatattaagtactagtttatttagggggtctagtaataagggtatattatctataagttcttctaatattatattaagtagtatacctaataggtcctttatagaactagtatcttctttagatttattattaggattattatctccttaagtagccctaaagctattatcctttaaattatattagctagtttaatggctttctttataaatgtaaaatatctaattaggccttatactttataggtttttttaaataatcctcccctctaatagtaggctataaatattttttataaaggtctataagtattagaatctagtatataaggctactcctcttaaaaatagatattaaaggaataaataattctgctattagaggttaataaataatagatatttatttttataccttagaagcttatataaagtacctttatatttataagcttcctatacttcctctctatttttaataagtaagctatatagcctataatataaaggtatactaggtctggttttttactatactaagccttataaggtattttattaataactatacttgataattaattttataaataggtaactatataaagtacctttagctactactttatatctagcctagctctaataaatataaggtaaagcttatctatgataatttaattaacttagtagtactattttatattaattaggtatagagggttcttagataattctttaattataatacttatttataaactccttattattattctcctttatattattaagataaacttaatagcagtaatacttagggtatttattatatattaagaagtattaaaactccttaagaaggttactcttcttattaataggcataacttctgcctattaagtaaagttatttaagaaagtaacctagtattaggagctattatatcttttaataggaaatagactatatatattaatatatataaatttaagggggtaggtaccctacttaattttatatttataagggtcttaaagataatataaggtaggcagaggtatctatctaaaagtaggttaatactaattaatattttttagagttacttaatactccctttacctagataagtaaggtactagtaccagatttctagtttggggtttttaattatatagctaagtaatactagcttaataagggcttcctaaaggtttaggaggtatatcctattatataagggagctataaattataataaataactaggagtaataatcttaatataatcttttaggtactctcctttctattaaaaatataatatatttaaaagcttatatttaaatattttaaactattagccttttatatatttataatataagcttatataaagcttataaagatattaatataaagcctctaaggatactaatattaaattataaaaatattaatataaagcttttaagtactataagcctatataaagcttaataaaatacctaaagcttataaagatattaatataaagcctctaaggatactaatattaaattataaaaatattaatataaagcttttaagtactataagcctatataaagcttataaaatacctataaaggttataatatagtgttattataaaggtactagtataaagcctctaataatattaatataaataaagaatacttaaaacctaaagcttatataaccctataataagtactaattaaaataacgtaagtaattatagatatagataattataattagataagaaatatattttctttctaataaaggggataatttttaaataactatttatttgttttaaaaaattattcaattaaataatttcatttttaaatataaatataaataataattttttataatattttaatttaatatatggcaaaaagctatggttatatgatggcatattatatatagaaggatagagaaggttgattagaaaactatctatataggagtctgctagcctatttatattaatcttagtatctattagaaaaatattcttatttttattcctaccttagggtctaactatataactttataattatataacctcttaactagtagaatagtaactagctaattctatctactttattactcctacttaaataattaataagatattatttctaaactcctattatatttctattctatattattatactcttactaatttataattactttttagttaaatatatataccttatctttagatcttttactttttaaaaaagtatattacctagtaatactatcttttaaatctaagataaggagtatttaaagtaataatcttatcctatctagcttatatcttaattatattatactcctcttagttatctttttctttttatatatttaataaacttctattaggttaaaagggggatattctttatttactcttacctattattagtaattactaggtatagattataatcctaaataattaggtattatcctcctttttaagacttaattaaaataatagcctagtagtactaggtatagtctttttattctttaacttttataattagatttatatactaagaagtataagctaaatattctattattatttaggtataacttaatagtattaaaaagtagttataattattatagtctagtagtatagagatctagttaatttttaaacatttattaaagaaagagattaggttaaggtagatatataataggcctagcctttaaaattaataaaaaattttaaaaatttaagtatatggtctttaaattagttgagggtaagaaaagagctataaaaataagataccctaaagaatatatttaatttggctaaaggtataaaaggaggattatattattatttataaattatatttatagttaactaaggcatttactaagtaatattaaagaagaaaactaagcaagaggctctatatctatagttagtagtctaggtaggttagaataggctaaatatattatatttattttaatctaaatatagtttagagttttataaagtaagattctcttaatagtagctttattaagatattcactatctagttctttatagaaataaactaaatattaataataccctttatttttttttatataaagtaatattatattataatatgttttattgttatataaaatattaggttcttaatactataataccctagttattatagtataaggttattaatttaggtataagtttataggagcctaagttaggattaatataaataactattacttttttaggcttttatttaaaataacttagtagctattaaagctagatagcttttttaatagcttatgttttacctatatattctattttataagataacaatattatagaggtttattattttaataactagctaattatatttttaaattaaagatataacttaaatagaatattataaataaagacctcccttattaagtctatatctatatatctataaaagggatatagctcctttttataaataaaaataagactaagatccttttaaggtaataaagaacctattttactaccctatgatagattatattaggcctagctataaaatagcttagtactaatataatatataagatctatatatatatattcctactattatatatataaaggataataatttaagtatattaggttattaagttagggttatttaccttatctagttttatcgctagctttatattatagatctattaataataatcagtatataatcttatattctaaatttataaagtaccttcttaatatatctttattaggagaattagataatataattctttttattatatataataattatccttaaatagtaattataggggcctaagttacttatataaaaatatttattaaaggcctttttaactttttaaatctttataattaatagtctaaagattaataaattattaatataaataatatatattaagttataataaaaaatacctaagtctattaagattagcttaaaaccttaaaaatattaaattacttgatatttttaaaatattaaatctttaataactactttagtttgtataaagccttattaagcttatatacctaagtagtcttattttttagatttattaattatttaatatagactttactattaaataatatagtattactttaataaaaagttattttaatatctatttgtttaatttcttaatttaatatagctataatagtaaataaagccttatagcttattagtttaataattaatataaatattttattataattaattcctttttttatttaaaacccttaactacctatccagtattaaaccttaagatttccctgtttagcccttaattttatatatttatttttcctttagtaccttctttcttaaaagtacctattccttttttattattttttaactatttctttaaatttagatcctcctatacctctttaaaagttttaggtttaagtatcttagctagtctaactattataactaagaactaataaagaatttaaaggattattattaaattattaattaaatatattatattaagtattaatttatttaaagggtttagtaataaaggtatattattagtaggttctttttatactatattagatattatctccaatatatttcttatgaaactattatctttatagatttagtattattaagactattatctccttaaataatatttattattttttaggctatttataaatactattagctagtttagtaattttctttataaaaataagaggtttaagccttataagttttattaactagataatcttcccctttaataatagcctataattatttataaaagggttttaaaatatctagatttagtaggtaagactattccttataaaaatagatatttaaagattagataaccttattatgaaaagtaaacagatagtagatataatcccccttataccttaaaagcttatatattagtactttaatattagtaaatttcttatacttcctctctatttttagcgaatgaatagattatatagctaatagtataaagataaactaaatttagtttctccctatactaggctttatatagggtcttattaataactaaacttagagattagttatataaataaataataatataaagtacctctagttattattttaatttaagcctaatactaataattatagtgtagaacttatctataataatatagttaagtaacgtagtagtactattttatttatattaattaagaataaaggttctaaaactattttttaaccagattatacttgctgcagaaaatcaccaatcttgttggtatctagttgtcccaaatgactaccgaatcagcgtcagcaagaatggttggacaaatgatgagataggcctcaaatggcttcaggagaccttcgagacatatacagcttcatgtacagttgggagatatcgccttttgattctagatgggcacagtagccatgccactgcagaattcgacaagttctgtacagaaaggaagataattcctttatatatgccaccacattcttctcatctgctacaaccgctggatgtgagctgcttttcaccattaaagtgcttatatggccagaagactcaggagatgatgcagagagggatccattctattgataaggaagatttctatatatctatcctgtagtccatcaacgagctttatcagcatcaaacatccaaagcggaatcaagacatcactcttggctcgtcacatcttccgtgattgatgcctacgtttgtgtatttctgactgtcatacgccgtccgtgcagtacgagagccgtcgggagtggggtcaccatttggaagatacacactcgttaaaatacgggccagagaatgagtcgatctgtccgttgtgccaggatgaaattcggccagcgacaaactttgagaggcatgttgggagacatttggaagagttgtttctttttgtgctaccacgagcggattcagaagataacgactcagaagtatcatcggcaatgacgagggagctagttcgctttcttagtagtatgactatcaatcttggaccccgtcctgggttggctggcgctataaattcgggcgaccctgaggaggaagtgccagacgatgccacaggggaaaatcacttaggttcgatgattgcacgcgctgaagtagaagggctggaggagcccacttttgaagaacaggaggaacaagagacgggggaggccggagaagctcaatattcctttctcgatgcacctacacgggcggcaatgacagcaatgttagaagcgttggcaaaaaggaaatcagctccagacgtggcacacataacattcgatgacgcatctggaaggctgtactggctgtactgggagttttgcaaaacatggacggtggtttctttttattttttatatatgtctgacacttcccaatgaagtccaattctcacttttttttggctgattctagaacatggaaagcttcatacgcaggcgattcaatgacgatgacgatttaagatcgcctgttgcggaaggccattacgacatgattgggcctgatggcagcatttatcgaccctcaagactgggacagcgtgatccaacctggttggacaataataatgcgcatgcggccgataccagaggaaccgaagacaccgcctccaactaatgtcattgaggaataaaagaagccggcaggtgcgtctatatcctagcaatcatactgaaatatatacagaactgactcgaggcgaaaggtttttttgtttgtgcttcatttttattcaactccgttggaattcagtggctaacccttctattagtggcttgtcgaagcagcaccaacgttctacaaagtggcaccaacagaccgactttctaagcgcaagaaggcagagcgcattcaaccgttgcataaccgctacgctggcgaggatgattggcgtctatccgcgcagagacgccaaggacgtggtggaggaggaggaacatggggttaaaggaagttgtcatctttaccgtatacccgaatggtcgaatttgttatgggtcgtctctacttactgttctctggaagtctccgagctggctctccttttcttctttttctttttccttcagccttccagttaactgctcttcgttggaacaaacggcattgtacagtgcttggcgtttggacatgggattcattcaaaaccattgattcttaattgatgcgggatgaccgtcttgtagtataatatttagaatcgtggaaatggactggcagcggtagatcatgttgctcagcacatgaacatagttctgtctgcttccaattcctccttcgacgagctagttctttctcactttttcttccttttgcgttatttacaagcattcttttaatagtaaaatatattaaatacgttaaatctcttgaaaaaaaaagatggaatttcgccactcccggtcgagtccgcgcggaacctgagacctgggaaaacatgggaaaaaaagaaaatcttttttattaacattcggaatcttattagtgttctaatccaagtcatgatcgatagatgctttctaaggagaaattattcttttataaaaaatattgtctagaaatagtaggatcatggataaagatgtctttttgcgactgcagagcaatgttagtaataatctttccgccggagtttttttttaggtcagctcaatgggcatagaggaagagttggaatttcaaaaataaagaaccaacacattatctctgaatacactgttgacgggatgcaatcatttttttaaaaaagaaaatcccctttcctcgtagtgtttgattttcaaagtacgtactgcatgctggtacatgacaggcgcaatctggcgaccaatcacaggctgcaaaaatctgatggcgaacatctctcaactctcgcatctacatccatcttgacttcctctccacgctcgctccatcacaacagccaaaatggcgtcctctgatgcacaaggccatcgagcgaagagaaggaaaatctcgtcagaggcgccttcttcctctgtcgccgaaaatgagaccggtatttcgtcccatacccagctccgggatcttctcattttccgacaggacgctccatctgcaaccagagatggtaagtgctatctaaaagatacagctagcgtttagacagtatcgccatctgacaaggggaaaaaaggtataaataagtttaaggagtttcttacatcaatcaatcagtcggagaaggaaactgagaaggccaagaaattacgaattctcaaggcctactgtgacacgcaaatcaaaaaagtgtctgatgggtccgaggccatttgtttcccggacttgatccagacttggagctttgcagacactagcaatcatgaaagtctgcttgtggtggttccttctatacttgcgatatttctaaagacgatatcgactcagctggactttcgcgacttcggcattgcactgtgcaagtatctgttgcaaaaggatcagctgaagcttttcaatcgcagtttgacctctaccaaggccaaagagcatctgatatcaccctgcattcgtcttctcacggagattgtgagctttgatggcggggccgtggcgcgactcgtctattcaaagcgcgaaatcacttttaagcgtcttgacgtctttctcaccccgaacaaggcgcagactgaggaggccttggacgagtcaagaaagtccacgctgagacgcaatactcagcgctacgtccttgcgaattttaggtttcagcatgctgcggccaagagagagttcgttgaacagcacaaagtcatcagagcgttcctggagcatatcagacgagattctcgtgacattgttcttgacattatcaaagcgattgatcgagacatcgcccaagactcttctcttcctcggagcacaaagacgaagttcttcaatcgatggaacttggagcgactcgtaaccctgtatggatacgacagggactctgatgcgccagagtcagaaaccttgtctattgcaaaggagatacacaagcttctgaccaaggtctgcacggtttcagaaatgggagttctattgccccagactggttggtatcctccggggagcgatccggatgccttgttaaccgaggatgatggctctattgaactggggttggattctcccgtctatctggacaaatacagggacagtgttccagtgcgcaatgggactctgtcgtcgctcatccaagtactccgtccggagtctgatacgcttcaaaccgagcttctattgacgatcttcaaggccgccccggaacttgttgcggacttctttaccaagcgaaccatgttcacctctgatccaaaggctacaccatcctggctgggcgaatctgcgttcttattctccactgtccagcttcccgttccagccaactgcggctggaaagagaaagttcctgccatgccgccaccgatttcggtcgtcatagaaaacattctgccccgtcctctcactcagaaaaccctatcaaggtgtctgaaccagaatacggacaacgtcattactctttttgcggtccgcattctgacggtcgctttccggaagctccaggctgtcctgaaaatatttaactctgatcatggaattggtcaatcattctggaatcaagcctcggccaagctaatcgcggaattctgccgtcgctgtcctccgatgaaagacgcggttctcacatttaaacgaacacccaaggaggacctgcaacagcgagatgcagttatggaactattgtgcatgttctacgaaacagtgccatccatcgcctttgaagagaatttcgatgtgacgttgattctagtagacgtcctacatcagctagaaaagcccgagctttcagcggacgattccgaactgctgttgagcctgttgcagaacattttgaaaattgctcacgtttcagcgtccatgcgttggtggcaacaacctggtaagggtctctacctgggtcctggccgagtttgcttgtagctaacatgaaaccagcatctctgcaatactctgcctttacttcaattttgaaggtcctagtgcaggcagccgacaagacgtctctgcagccaattcgtgtactgctacaaagcgtactcgtagagaattctgttctaataagtgctgaagcctcgttcaatgctctgatctccagtctggaagcctccacgtcggaatcaatttcggcgcagttggagttcgttgacaactgcgtctgccgtgtagtgaagaaaccggttcactaccaagacctcgtttcttcactgctagatcacaagccaggatcgcttagttccctggtcgccgctgtaaacgagcaatggtccttcgccctcaaagccaacgacgcatcgagagaacagtctatcgcttcgtggattgcgatctttctcggagagatgaaacgggcaggcgaagatgaaaaagcgctaaaatcggtgcgcagtcacctaattgatgtaacagagtcaaagaagactaggtctattttcaagaagactttgaagaacaccgcggagatggacagcggagacgaaagaatggtcgatgccgatctcaatcaggaccagaaacaggccaaacgtgcagtgtctgcagatctttcgggcatgtttggtgatcttcccaccgaagacaagaaccacgcggcactacacaaatgggaacatgatgaaatcgatgtggcgatcgagaaaggccgcatcagggacttgatgctctgcctgtgctctgagcacgaggaggtcaggcggcaggcgtttgtgggcgtttcccgtttcatggctaaactcaaggtatgcatcccgggtccaagcttgctatatcccagtaccttctaacagaggcaggaatcaaattactctgagtggcgatcaatctatatcttatcgggcgagttcctggagacggcgaaccatgtgggatttcaaacgccgcttccctggattgccggtgaatgcgctgcgagctgcttgatggtcttaactgatccgctgcacaagatgtatggaaaggtcaacaagttccttcagaaacgaccgtcctgggagatcgggaagatcccatcttactggatcgacaagatcctgttgaacgaacccgagtacgatgacggctatgttgacgagatcacctggcttctggatctgttcgtggggggccttcggactgcccaggtaggcatatctactcatctggaggcttgtagtcctcagcagcacaggactgattcaggaacaggatttggacatctaccgtcgagccaacgtcttcgagcggatcctctccctctacaactcgccgacgctaaacgcatcgctgaagaagaagatcttgcatcttgttttccgcgccactcaggtgggaggagggtcaacactcattacgagggcggcggctatcagctgggtccggggccagatggcgggttctgatccccatagtgccatcatgtcggagctgaccagggccatctacgactcgagtgaccacgaacgtgttgacaagtggagtggcgcatccatcccacgcctcgtagaacagataggaagttagaaaagtagcataggcggtgactgttgtggagtactctgtaatctataatgcgggaggagtccaaatgtcgattagagaaaacagtgtagatatcgtggccacagcgtgatgcaactccactgattaatgagcaatgagagtattatctggctgggtgctgtgtttgtggagccagcgttgaggtgtcacgccgtgaaaataaataaataaagcccgggaggcgccgacaggtgaactttcccctttaggcagcgcaggcaaaggcccgaccagcagcgaacgtgtctggctgcgcacgcctctccaccgtgcagaactcgcctttctctcccaaccatccttgctggctcccagcacgatcccattaatatctggaccgatccatctggacatatttgcgaatctggccactgcacactttgaccgccttttgactcctccttttgtcagctgacgaccaaattccaagtcgagcggaaatttgccacgagcgagagagagagcgccagcttgctcagcaacgtctatccagaaaaagaaaacaagggccgcggcaccgtctcgtcctcgctccctggatcggatcctctccttgctgctgatcctccttcgcctcgtcctccttcgccttctaccttctttaccatgagatctctctaatcgagccctcacgacctaccaccacctacctgcaacacacgcaaccgtcctcccgatggcacgtcgctatcagatcgaggaactgctatggctacgcaactcgccactagttaccaagcccgataaactacctccaattgaagaatggatggggtaagtgcctactcttcgtcaagttgttgtcgttgcgccctcacgctgacgctctctgatcgcattactccagaccggcccccgacccatccacacagcgaaaaaatgcaaacgctagagataacaaccagaatgacgctacaaaccggcgaccgaacttgtttgagacacgacacaattctcgaaactcaaattcaggtattaaaaaaatctccgcaccaggttccctttttggcctctttctttctgtcttgatatcagctgctaaaactatcttccacttcgtttagaggatatcatactaggcccccccaagacctcctttgcgtcggcttcacgcttctttgggaagggatcggtcgactcccccgagcggtcctcacggttcaatgattcggacgataccaagagtgatcgttacaacattcgagaaaagttcttcaaggatcgagaagcgggggacaaggaatttgacagacgcgataacagatttggaggagcaaacggccgtcgaggcgaccgagatgactggaaccatgggcgaccgcgtcgcaactttggccaggatgaacaggaccgaagaccaagacgtaatggagaaccagaccggtgggatgttaaagacagagatcgtgatcaacaacacgactctggctatgacaaaggtgtcagagataaggacagtcgttattcgagacgggatgctcagggaagagctagatacgaacagagttggttccgggatgaaggcgcttcggatgctgcagagaataatgaagaagagaaaccatcgatacggaacagagagtggcgccgcgaccgacaagctcctgatcgtgattggaaccggggggcgaggtttgaacaggagcctgaatggatggattccatggaacgagatgacacgaagcaggctcacacccaggaagaattccaacggtggaaggagagtatgaaagccagaccacaaacagaggagaagaaagaaactgtacccgaacaggcaactccaactgcgcagaaggcggaggcgaaacatctcgacggggagttgttccacagcaccgctttgcagatggattccggcctggataagttttttggattgctgggagagaccaaaccgtctcaagacgcggcgactcctggctctactgattcgaacaaaagagattccgcttctatcactaagcctgggaagtcatctcgcttcgcgggcttcttcagccctcctccggatagtacgaacaaggaggctgaaagcaaagctcaacctgatcgttcaaccgcgactgatgctgatcaggaaggcttccagcgcatcctgcagatgcttgaaaatagcaaatcacgcaacacgactcctcatgtggacagttctcagcagcctcgcccaccacccttggcacaacctgaaccgacccgaccggcagcattctcgtccccaaccaggcagcatgagtacatgtcaggtcaggatggtgcagcaggcgtgaactccccgcgagacgcgcaagctcagcttcgagaccgagaaaaccttcttcgtctcatgcaacaagtcaagatatctcctgggcctaatcagcagcaacagcagcaacagtatggaaccacgcagccgcagagtacggcagggcacacacctggtattctgaatgtgccggatctgctccaacggtcccaggggattcaaaaggcgccaacaaagaatccgaacttcttggatgatcctgcaatcgcgaatatgcagagaccggatgccgagctcaacgagcaaatgagacgatccgccgccgccaacgggcctccgatgggatactttgatgaaatgggattcccaggtggacaggcaggcggaagaggtcctcagggccatggacaaccaccgatgggacttcaacgacctccgggtttcgaccagatgccaccaccgccaggatggggagcgcaacagttgcagccacagcaaggtggaggaggaccaagcccgttggcaccgccaccagggattccaacgccgtcacgggggatgaatcccaactttgtgtctgggccgatgccaatgcacggaggaaacatgggaccggtgagtgagcggccgccgttcccgcgcggcatgagtggtaacaactcgggtgggaactttggagctccgccggggatgatgcctccgccaggatacatgaacatgagcggacctcctatgtcggggtatccgccaatgccgcataatcccgaggcgatgatgaatttcccgcatggtggacaaggcaattttgggggaggtggtaactcaggcccatcgggagcaccgccgtcatccagacatctgctggagatgtttgcgcaagccaacgggggtgatggcagaggcggaatgccaggcccagggccgtaccgttgagatttgagtggtaaatgcgtctgcagtctacggatacgtctgaactctgatcttttcatgtggatgaggcatgtcgagcttctctgctgctgtgctgctacgtttacgttttggttggtttcatgacgtatgattttgtgcactatttcccaggtttgtacttgttcgatcgatcctgttatgatcaattccttttctttacgatcagtcttttttatgatcgtggcgacagcagcggagacgcttgacgaggtttcacgtccacatgggaagaatcagagcgggcaggtggaagaaagggacgtctagtctagccaaggtagtaggtagattgatatttgggcatgatttccggcgtcccaagatatccgatctatgatctatgagcgagtaagatagtctcaatctaatctattactgagcagaaaaagacgacgacgacgacgacgacgtaaataaagaaactatcatcaactaagtaatcataatcataataaactaatctgggcgtaatttatttatttttaattgaatagaattgaattgagaaagacaggtaattcactaggttatacctacctacctacctacctacctatattgtatgtattacagcacacatttacatactactttctaagcagggtagatatggattagatagatagatatgtaggaatactgaaaggggggggaaaaaaaagggaaaggtgctggaagaaaaaaaaaagatcacttttgatttggatttgataatagtaatgaaataggataataaaataataatgtctgtcctaccctatcctatccatatcatgttcgttcttttcgtgtcactgtctgtctgtctgtctgtcatccatccatcctccatccagtcggtcagtcagtcagtcagtcagtgctgctgctgctgctactgctgccgctggtggaggtgcatacatattctcatcataataaaataatagcagaacaaacaaacaaataaggaaacaaacaaacaatgtccatccataagtaagtagtaagtagtacaaggcgtcaagtcagtcagtcagttaactcgagacacatcatgaagaggtagaagaagaagaataataatacattataagagaaaaagggggtaatgaaatgaaatgaaggaaagaaagaaataaagacaagaaagaaacgactgtcatagatcactccacactgcgctcagccaccccgtcggatagcccacctcgctgttcgtaatgctgggccattgctcgcagctgccgccgtctaggaaggccacgacgtcgtccccgcccagactcgccgtccacatcgagtactcggcgccatctacccccagcgctgcgggtgagttagtagaatacgcgacagagcccgggggcggcagcatcccaccaaagccatgttgcgccgtcgcgctactgattggtggcagtgactgcgagtacggaggcggcggcgcctgctggtgcgaggtcacccatgaattgagcggctgcagacggttggccgagttggccatgaactgtgacggaggcggttgttggctggtcgatgtcggtgctgtgaacgcccccggcgatgcaagtgatggtaggcttggcgaggcggtcgaatgatgctggagcgatggcaatgggtatggagactggcccggtattgaccgagacgttggcaggggtaggctgggccgccggtcaacctctggcctcgcccgttcgccgtctggcactgccatgttgctgttgctgttgttgctgctgttgctgttattgttgttgttgttgttgtggttgacaggcacccacgattcccgtcgttgatgttgttggccaaccccgtccacttgcgagtcaccgccgtcgcccgactcgcttttgacggcgttgctgcccgcgtcgctggcggagaagggcgctgccggtccagatccatcgtcgtccaacgccgccccctccggcacctggtcctcgatgttgccgaattctaggaacagtttctccagcagtttgaattcgtccagcccgccgcccatgccaccctcgcgcaccggccggatgccgttgacctgaccgtccacgccgtctgccgggggcatcgtctcggatttgcgcgcgttggcccgaaagtccttcttgaccttgacaaagtagctgtggaggcggttcagcgtccggaaccagcccgccgccatggtgagtcgctgtcgcatgtcccgcagaatgtccagcgcccggcgagcctgcgcctgtggctgggtggcacccggcccggccggggcatcggcggtggcgggtggtttggacgacagatatccctccgtatccatgtggctgaagtgggcggcatagatgccaataaagacggcgttgtagatggcgaacccgaccaggggagtttccaccagcactccgcgctcctggcaggtgatgaccagatccatcatctgcctggcagcccggaacagctccttggcgctgtcccgccagaagccgtcgggcaaggagtacttgtcccgtgggaacgtgggctcgtccagagggccgaccggctcgctgcatcgaagcgggaggaacggaatgtaagcgcggtgcaggacgatcaccgagaggaagtagacgacatgcatcacggtgtaggatgccaacgagtgcttgtacatgatgtgcgtgtccgtattccgttgggagtactggagattccggggcagattgtcctggaactcggcgagcttacttcgcagctgggcaaaacgggactctggctgccaaggggcgtacgattcatttctggcctgttatcagcacatggattcttaccctgccatatctatcatctagttggacttgagtgacttaccgtctgcctccggcgcaggcccacttggcaatactcccccagatgcgaatgattcggatcacgcggctcaagacacactcttcggcacccacttcccagcggtcgatatcatgatcgaccgaatcgtgtcgttgggcaacgggcgaccaggctttggtgtcagtggagccattcgaccggagcttttcatcgccataaccgccgatgctctgccgtaagctcgggatctgcaccccctgcggagagtcgaaactgggcggtcgacggaccgagctgtcgctgagtcgggacgtccggacccgttcgccaaacgcaaaggcattgtcgctcggcagctggatggccaggtcacgcaccttgatcatgcgcggccgatacttgccgctgctcagacagcggtccatgatgaagcaggcccagaaggtgcgtcgcttggtctcctggagaatcacgtcgtcggaattctgctcgcgcgactcctttcggcgcgggagcccgaaatgatcggcttcgaccttcagggcgggcgagcgggccgtctcgttctccagttcgaaggggagacccatggcctgtgagagccggatggccatgcccacgtagacccaggcgctcttgccccggcacatgccccattcgtgcaacgccagcatcaacagggcctgcacgcgcgtcaggtcgggcacggccaggcccatgccgtcggggccggcgagacggttccgcagggcggacgcgtagaactcggaggccaccagcgggttcgagggattgttgggcgcggacggcgagtggtaggcgaccagctgcgggtggaagcgggcggtcagggccagcacgcccagcaggatcaagggcgagggttccggcttgggaccggggctctgcgagggctgctcgggctggccatcgggctgggacgcggacagttggcggatctgattcaagaaggtggtgggatggaggaaggggaggacggtagcgaagtgggattggaacagctcgaacaaggtctcccagaccttgacggtgaggatggacgagtcgaggacgtcgacgttggtcttgctggcatccttggcagcaggcccggaggggcccacggcctttctggagcgttgtcgcttgggactgtcccagtcaccgtttcgatcgtcgccgtcgacggtggccgcgatgtctcgtttcgcaccgccagcgccgatggcgggctggggatagacacagacgcggccggacgactcgcaggcgcggcaggtggtgtcaataccggcattgacgcatttgattttgctccggcgacagcgggagcaggcaatgctggagcgcattgttagaagacaaagggatggtgtcgtgttgttattgaatcgcggagggaagcagctgcagtgaagcccgccgccgggacattcacggcgaccaactaagttgcagagcccgggggaggtggatccggggaagcatccaaacgaggagagactgcacgcgagctcgccagcgggcagccagctggaggagcgcagaaaggtgaggaaaaagaaagggcgtcccgaagactgagactggggagaaggtcagcacgcaccagcggcgggaggaggacgagggaaaaacacgcagcgacgcgaacagtgcggaggattctggagaagaacgacagatctcagatggggcggagagatgcccgaatccccggtaaatgacaagacagccgggcgagccggctgggaacaaaggcgccagcagtctcggcgtgcggtcggcaagcagcggagggaggatattctcgtatttctctctccttgttttttttgctcttttttgctttgttttctttttttttcccctttcgtatctccccctttgtttctctcttctttttcttcctgctgagttgagtcttcgaggcgaggagaagcaaggacgacgccggagagcaagtggagacggaggggagaggcacgacgatcggcaacggtcccgagaggcaggcagcacacaggagggacaagactgagggaaaaatcagacgagagaagaaaaagagagagagagaacagaccgagcgaatgccggatcggctggcagaaaagactggttaggagagatgctgcccctctgctgcaccccgggaggagcacaggatggtcgttggggcgcctacgcttagtgtttcgcggggcgcagcatagcagccagtcaggccgggctgccgggggcgatttctggggaatagcaagcaaagcaatgggccggtccggcttagcctttggccagaggatggattgtatttgtggcggtcgcactgcagccgacgagagcccgaacacttttctaccgacggagttcgacggaggagacggtcgggatggaccccctccagctgtggaacattcagagtagtagtagatactggtatctgggttgtagaaaactactacaactactacaactactacgatgctggattgcattctgcaaagtcaagcgaccccaccagctcagaaaataacttgcacccgttctagatcgaccagttataccgagtaccagccctcgcaggtggcatcggccaggggcctgtcctaccgtgctgtagcttgtctcccgtggtccgacggagacgcgcatcctcgtcctcgacatcggtgccggtgtactgtactgcgaacgcactccgtgcacaccgtgacatccagtcaccgtacacggcgtgcggtggttgcaacttgcagcccgaagccctggccggagggctccggagtccgtcaggtagtgtcccactcgctgattgagcctggcaaacgacaatcccccagacgatcagcctgctctcgctgcgactttgcgtcacaatcccgagtcagaccggcggtctgccaggaacctagccacaactgtataagaatcataagaagtacggagtactctgtattctggcggatgagacgattcctcgcgaatcaccatctaacaataaataaatcatcgtggcggatgagcaccggcgtcggattacggaccacagccgagaattcccccagccgttccgtatcccgggagaaccaagacgagacagagtgacagactgatcagtcggtcagtctgtctgtcactcagtcagtcgactctctaatagtctctaccctcctgcatcccgatatgcaagcacggctgcgcataccctcggggccgagagctggaatgctggcagcccggtgtgcacgcaccatcggccccctcgcccgctaggtattctttgcctccaatgaggcttcctcgggcactgccgtcccgatgcgtgggccttgggcaggaatagcagcttcattagcagtattttccaccagtagctcgctccacgctctccacaatccccatcgctcccacattctcgagcacggagtaggttaggtaggtaggtttgatcgggctaaaccccgcaaagtgcaaactcagctggtgagagcactgcaacagaccctgtccggggcagctgaataatagcaccctggcgattggtggtgactttacctcctgcatggacgggcaattatttattcatttatcatgtggcctgtccgtcctgaactagatagagtttaaaaaaaagaaacaaaaaaagagagagagagagagtcaagccatcgcgggatatcgggagcgacaacgacagaaaaaaaaaagcctcctgagtactccgtagtgtcctgtactgtgcgcgggaaggtgcacacgaggttactacgccagatattattatttcccggtggggggggggggggaataatgattcaatcaactcactctcactcagggcaggccaggcttaggaacggcaaccccgggagataccgatgtcccgtcccgtaccgttcgtaccgaggtgagtcgtgactgactgacactgacggtttttccgggtcgacaggataccgtgacatggggtagtaatagcatcgtacggatagtaatttttttttattatttactccagtggagacgagactagaacgagaatgagaactccttacacgcgaagaatgtggagagatagataatccagtctgtacggagtactgtactttgtttgtttgccagctcgttccgctgtggcattctgatggaccgctcttgtaacgttccttttcctcaccgtggcactggaggtcacctcttaccccgcgtttaggcgtgacctcgcccgcgttcctcgttcccgtctctgtcggtaatggcagcatggctagccccggccttcgaatgcatgtcatctcgctccggcctttcattattacctattccttttactaatccttcgccgtcgctcggcccgacttttcgaccagtagtggctcctacgccggaggaaaacccgcatcgggtagtctcatatccatgcggaatgcacaggaactctgtcaactgccaagggaccgagttgggtcacgtggctatcacagtaagagtctagccagtatctgtcacacagtatacggagtacatgcacatggcctacttcataccatatcctaagcttatttcaatagaatagctgcgtacataagataccgagatgactctaaccagtaggtctcaccggtcccacagatgaaggtaatctcccacaaaggaaacagattcgatcgccgagaaaaagcacacaaggaaatagaataaatccaaaccaaagcacaatcataataatacacctcagaatcatatgaaccgaaatcctcaaggtgaagcctggaaatactctttcagggtatcatcttcagcctctggccgatcaggaagcaagaaaataagagaaataagaaaagtttaaacgatcgtgatgcagatcagctggttttcgcattggatggataaaacctgcaaacccgttagtgattatcgaatcgaatgccgcagagctgcttcatcttgcttaccatgatgccaccgcaatgatgatgtacagcgtcatcagcaaaacgccctccagccagtgtgacttgccatcggcgatcagatagttgacctgcccagctcgttagtcgacagagagaaaacgagaaaggagacaactgaccaggagcaccgaaacgaagagcacggtgatttggaatccatcaaagtacagcgtctgtcacggttagcctgcatccaagttcctctgcttctcacggagcataccatgtcagcgttgcctgcacggcatcaatcagtcagcaacagtcaaccagagtaacgatggtggcaagactcaccgataatccatccgatcaccacggtcagtgggagaaccaacagcgcaatttgcatgctggatcccacggccaccccgatggccagatccatcttgtccttcactgcaaccgtaacggccgtcgcatgctccgctgcattgcccacaatgggaagcagcactaaaccgacaaacgtcttggataacccgccatcctcggtgattttatcgatcgaatcgacctgacggatctgttagcctggctcgggtcagagtctcgggacggcactgtccctaccatgaactccgcgcaaactgcgacgagcgcagttgacgccgcaagagtgaagacagcgaccgcgatgtggagctgaggttcttccgtttcttcctccggctcgaccatctggacatgctcgttcttgccggcgaggctggcgcccatcatgccaatctgggccaggcctttgctagcatcgccctcggactttttgttgcctctcttctccgtcttctcgcttggtttgttgtagatctccacgtgtgacttgagctggaagaacagataggcgccatacaccaccaacaagatcacgctggtacctcgagacaaaggcgcaattccatttgtgccagctacaaagacgttagttggacgatgaaaccctccacatcttcaggtcaggtcacataccgccagaccactggtgaaaggcagtgggaataatcagactgccgacagccagcgcgagcagactcgacgccgtctgagcgacgaccacgttgaatttctgttccattcggttcactccgccaaagaagaagcacatgcccatcaccaggagcaggttcgacaacatactcccaatgagagaggtctgcacgatgaccacctgattatccacgagggccaggatggcaacgatcaattcaacagcattgccaaacgttgcgttcaacaggccgccgagtgtctccccagttctgtcatttggtcagcactggaggtgaacacactggaaacagataaaacccaccgtagggcgatttcctcagttgcgtaactcaacattgcagcaaggggtctgagtagggttgtcagcctggtctaggatagaggtgcgatcaatcttacatgatggcgataaaattggtcacgaagatggccctgggatccagatgcagacaattgacgataactgatagaaatgtcagtcacacggtgatgcagagaataccacggtgaagcgtacttccaatgggcgcagcgaccaaaaggacattgatccacgaattgaagatggtcgctttcagctggccgacgacggtgaatttctgcttgtctgagacggacttttgctcctcctcgtcgtcgttttgaggcggggtgtcggacgtctttttcctctggcgaggtccgccctcgaccgaatggcgggcgtcttgggaggtgctgatcggctcatttggagtcgtctgcgaaggcgcgtctctctcctcgatgctgccatcgacggccctggtctggtcgctgctcgaggatggcggtggaacgacttcagtattctttgcatcctccaagggttgccgttcctctgctgagccctccagcagaccacgctccaactggctcgtgcgacgacgcggtggacggactctgaacttcttgaacggattggggttgcaacccgcttgttcttcttcttcccggtcgtaccaggccagggacctggccgcatggcgaactttgtctgcaacaggccgaagttatcagccaggggaattgaaacagtttttgggcaagaagtcaggccgggagacttacgcatggtgtgggaattgtcgatgcgggcgcgcaaacaaattgaggtgatgcgcaaatgggaaggaaaacaaacaggaggaggaacaacaacaataataatggaataatatcccacgtcgtggtggatctggggcttctttattagaaaaggggcactgcgggcggtggatcgtcgaaccaaagcttgaagagaactaaacaggcacaagtgtggcaggacgggcaattatttgtcaagccgctgcaatacgccactgctgatctgattgatcagactgatctgcgccgagtctcaatggcgtctctcagtctttgttctgaaacggtacagcagtcctgtcgggcttggcgggtggtgcctgtgctgcgctggcatgccccagctgcagcggatgtcaggcgaattccagaggccaacaagtaactactaacgagcagccacgatcacagccagggtcgtgtgctaataattatcgattggcgactagtaatggccgaagtggatgctggcaggcctggcgtccccagtatctcgctcagccacagccccaggcgtcctgctttgcttgccgaatgccgactgaaacgtgggttatgcgctgtggctggtagtgttgataatcaaagcatcagcagatgcccacatttaggcatcaacaatagtactgtcggtattattcctccagggttgcaggttgcaacggggaagccgcgcagaggacatcagactgggccagtcaccagcacagtcagactgatgacacagggaaaacaagccgatcgcttgtctagacgaggccaagagcgaccagcggcaggtcagtctccgcacaccatcttggcgagggcgcgttcctgactgttccacttctcgggggccacgcctttgacatcagtgtgaatcctccacaactactgctattgcgtcgactgatggcagttgttctcagatgccagaatactaaggcgatctagtcgtgagccgttgctcaggccaaccaagccaccgccaggcgcgagcctttgattatcgtgattagcgtgtccccagcaggtgtggcgcacgcggtggattaatcagataatctgcattgccgagataaaatgtgatcatcaaaccagcaccgcactagctcgccttcgttaccgctatcggtttctgcattacgcaggtatctacgagcgtcctcgaggcggttctcaatatgctctaacctatctggcaatctgcagaatggtcgccaaagtgtggctggagggcatgtgcccagcaggtgccaacgagcctggattcatcagattcaggccttctcttccctgggagggaagttcgtccacccaatggtctccgtctccttcaaatccagcatctgattcccagccccaaatcggcccaatgtctggtctccccagaatccctgggccgtctcaggccgccacctccacgaccgcctgaatttcttgtccagagtcccttccatgcagtcgacaatgaatcccccgatcgatggcacgtgcatgaatccgtgcccagaatcgccagcggccaggatgagcgactcgtaggagggatggggggttatgagaaaggcgcggttgggagtgtccgcgcaccagcagacccgtgcatggacgaagggtcgatctgcaagatggggcatagtatcacgcaggaagtcacgaacccgctctgcagcggggatcgggatctggtgtttggctaccggaatcgactgcgggagagaagagccggacgagctggacggcgggacccagttgcagtatcccggatgttcgtcgcagatcttgagctcgtgccggtcctcatcgggctccatgaagaagcctttttcgatgttgaacagcaccggcaggtctttgtagagctgcgcttcttcggccgtcatgggaatatgtgccaacgtccacgccgtcggacgcagttggtttctcgaagtcaaacagctgaggtgctgtcgccccgactgcgagaatcgttcgatccgcgcgatgctcgacgaccgtccgcagtcctcgctcccaagacgtccgattcagagtacaccagacccgtcacctctccctggggactgcctgtaatgaaattcacccctagacgggaagcctccttgtatgccgatacaagcgtttttcgtgcgtgaacccatcctgcatcgcttttcttgtagaatcctcgccaacctgtgaactcgcccgtcaagaccccctctgggcatggttgcgcggaactcttccgccgtattgagaggcgtaaatgaggacgcgtgatgacgaatctcgcggttcttcagatgctcgagagcggatgaggacgaggccgcgacaatatagcctgtatcatggtagtatggggcgaacacggggtcgttgttccagccgtccgccgctgcggccagctgcgcggtggccacagctgcttcgtcgtcgccctctgtaaacgatccttgacgggattctcgtcagtgggcggatgaaatgggaaagggaatgattgcttggaccttgctcgacaattttattgatgtcgttgccagccgaaatgggcgagggaattggatacgcatccaagacggtcactcttctgtatccacgccgcgctagatggagagcagtcgagcagccccaggcgcctcctacaacaatgagaatggaagattccttccgaagctctggtgccatgttctcagttgtgacggaccagtagcgatgctacaagggttctctctttgggaagagattctgggaagagatctttatagaaaaacagaaactccccagaatcgtttgatttttaatcttatcatcctagtttcgataactgttctgctaaaaggtccaagcaagcggagacgtggccgcgtgttctgttaccatcgagaaggtccagccgaggcttatcagcgccagcaggttggcttccccacaaatatatcgccccgaccagagctcgcatccccgtcagtgttccttcgaccagatggacgaggtggacgaatgaagatgcccacgagattgtcctatgcctcgtcgaaagtcatccgacgccgcccccaccaagactcgtgcgcgaaaccggctgcaagacgtgtcgcaggcgcaaggtccgctgcgacgagaacaagcccagctgccacaactgcacaaggcgaggcttggtgtgcgacaccggcttccagctgaaatgggaggtcgactacgtccgtcggggcctcgcctttggccgtcaaggcgtctggagcaagcgtggagatgccagggacgagccatcgttgcgggatatatcgcatgatgccgtggaatggcgtcctttgccaacgatcggcccgcaccacttcctcaacacctcggtcagggacttcgaggacgggggcgtcgaggacgacgttgcggagaggagcgatgaagtcagcgtcgcgtcgccttcccctacggctgatgatgttcttctgtggacagagccttcgatgttccccagtctttctggaacggcagacatgcatctgttggactactatctgcagagattggcgcctctgacaactcccgccagagtggttccatccccgtttgcaacgcacatcgtcccgctcgtcacaacgggcgggtcgagcgatattctccagtccgtcccggcactcgcggcctgccatcggagcagaaccgatgcgttcgtggtcgcagtccgccgtcagactcaagggaaatgtcttggcctcactccgaagagccgtggcctccaggagcgtggcacagctcgtctgcgatccccacatcctggtcatgatgatgtttatgtgcctctacgaaattaacgacaactgcgaccgccgctgggtgatccatctgcgagggagccatgagataattcgtcgacgccggcagctgagctttccctctggtcagtctgcatcccatccgctgacctctttcgccgagcgctttttcgcttttcaggatgtcatgggccggactgcgtgcggggatgtgccgttgtttggcagtgattactgggagaaccttgagccccaaatcgaagtggacgcttggatgggctgtcagtccggggctggcaaggattatgtgctgcatcaccgatctcagcccgcaagaggccgaagaacggcgacccattagcggtggcgcagttcgccaggcaggctgcggctcttgagagcgatctggaatccccttcccccgccagtcgacgagagcgtcgacgatcagcttgccaaagcggccgaactaaaaaggctggcggccgttctctaccttcactgtgccctgtataatgcctcgccgtccacgccgctcgtggtcgagcatgtccgtcggattctccagggcgtgtctgagtttctccggatgggagttgttgctggtcttagttttgcgctgttcgtcactggaactgagctggacccgctgaacgacgagatcttcgtcgacgacgaaacgggcaaaccggtttacggccgacctctcatcctggcagcgctggacgccatgtccgcctcgtcggtgtccaacgtgtcgaagacgcgcgcggtgatccgcaaggtctggcggatgcgcgatctccatctggaggagcagaccgacagagacggctctctgaacgactgggagtattttgtggcgcccgtcagcgccaatgtcagcttggcgtgacggtgtacggagtacgagtgtctacgagtatcttaatttgatttgactttgtattgcagtagtacatagcattgagtagacccaccggcccacagataagagctatgctatctagatagagctaatttaggttaacggattgacctggggaagcatgcacctactacctagctaagccaggggatcaagctgtggccagctcgtctggaccttcttgcagtcgatccaggcccatcctcgcgccaatgatactggtcatcgcttatccactgccgccctgggactagtcgagtcgagagaatatcacgtctgttgatgagtgtcgctgaagctgctgtggatataaatacaaaaacaagccaggatggataggcttggtcatgtccagcatgcgatgctcttcgtcacctttctttctttgccctgcaaaatagctgcggctgttacagggcatggcgaacgaaaccagtgccgatgacccagtgcccggcaccgagctgctcgtggacggtagtatattccagtctgattattttcagaagatagaggcattgttgctaactaatctatctgccttgtaattagttgggaaatcgctaaacctctcgcacgctggcgctggcacttcggatattgtcctcattctgcagccgactccctgtggcggagaccccgttggtaagactctcacacacactctctacctgtactgtatgtatgtactgtactgtacagcagctgacagatcttcctcagaaatggcccacatggaaaaagtattaccagctattcctgctcgcgctcttggtacgtacctacatcgatcgacaggcttcgtcaacatctggtggattcccaccgcaaacaaaatcggccgccgattcgtcttcctcgccacgacagtcctctgcatgtgtgtgggcgtctagacggctgggaaagttcaatggtacatacggggcagtcagtggatgacgagcatggtcttgaatggccttgggacgagtgcgtatcaggcggttatttattcagcttgcagtacgtctcatctcatgcatttggtgcatttcatgcatttgatttttgcatgctaataaagagggcaagtctttgatatgttcttcgtgtatgatcgcggcaggatgctttctgtctatctctttggccagcagcttggttcgatgtgagtgtgctagattctagattcgactagttcaaggacccgttactaactaatatattgtttatgttcagcctgggcttgattaccggcgggagcatcgcgatagtatcggctggcgctggagccagtacatacatcgtcgccatcatcgatgccgacgtcttgctgctcttctttttcacctcgaattcgaggagacgcttttccctcgctttctgttcttctcaacacagcccaacagccctggcgctgcggcagacgactcgggcgagtcggcagcccgatcatccattgtcgacgacaacaagtcgaacaagtcgaacaagacgaacattgtgcggacaaatcccccgaatcatgagacggggtttgtcaacgccttcccaaagagaacatacctccaaacgctcagtctgtgggtgtcctacccgcagaacaagacgacgttctggcagtacttctgtgaccgttttccctctggtcattccccaacgtcgttattgtaagaatactagacttcacaatctggtgcatacttaccagtgcctgcagtccggcttcatcttcgcctcggctgcaccgccggcatcatctccgtctccttcaacaccatacataccatctccgaaatcatgacctccccgccctatgtatgtacaactggagcacaacagcgacagacagggctgatcttcctcgccgcgctggtctggtgggcaacgtcctcggctgggccaccggcggcgtcctcagcgaccagctagctggtcattgccctggcccgccgcaacgcaggcatcaatcaaggagcccgagatgcgtctgtacagtactgtacatacatgcttcccatctgcgccgtctacgccgctgttggatacatgctgtatgtactgtacggctggggtggtgcggaaaggggtctgtcctggatgactgtcgctatcggtcggtatcggagccatgatcgcccattaatcaatcaggtctctctctgcctgctctatcgtgactgactgcttatgcgatggagtgttttcctggtgtatgcctgcagcccccttagcatcccaccaagccatcactgacattttttttgtgggcaagatttcacgcgacctcgtcgtcctcctcgccatgtgctcctccaccatcaacttcgccatctcctactctctactcggtgcaacccttcatcaacgcagcggggtacggctggccgtttgtcttctttggcctctgcgtgctgctgtccatgggggcggctatccctatgattgtctacggtaagaagtggaggaggcggaaagcggcaaggtactatcggtttttgcgggaggttgggcgggaagaagtcagaactgactgattgattgattggattggattaaagagatgcgtggatgtagcttggtttaggtttctaaagatatatatctcttactggtctgtatgcttattcatttacctgcgacagcatacaacgaggaacaatggaatgaacatgactttttttttactattatagtaggtacaaggaccagtactctatagaacagataataaatacacttttatttccttttcttttctctattgctaaatataaattatctgccctattcatgcccatacatactcactcatatcatatcatatcataacatgttcatgcttttatatcatcatttatatgttcattttttcatattcatacagataagaataacaattcgttcagagataaaagtaacttttgtgtgaaccaaaaaaaaagtaataataataataaataaaactcaagaaaagacaacgataaatcatgactcctcctcgcatagcgggtatcaattaattcattaattcagtcgaaaggttagctctcagtgtacaggtttcaggtcgccacttcggggaccgtctttggccgagtctcgctggggtgccatcgtcggtgtggtcctcggatcaatagacgtgtttgctgcttccattagtggattgttgttattgttgttgttgttctcagattccacagccgctgacgagtagtgatgcgcgactacactggcgggcaactccagagacggaatggaggattccatcgtcgacgacgtcgacggcggcaccgtcggtccgactcgcgtcgagagcggccgtacctgcacctcgttgtagaactgctgcaggcgcacttcgtcgttgcagaactcctcaacctggttcttcaggtactccggagtgcggtagagatttgcagtgtcaatcgtgttcgatgcattaatccctccaggcccagcattgacgtttggttccggcacgggacgtacgacaggcgacagacgcggcgagaacatcggatcatacgtgtaggtgcccgctcgcggtcgatgatactgctcgttgcggtccccacgatcgaacttgtctcgaccggcccccttggtgctgaacagccggtttgcgaggaacagcaaatctccctcgtccgaaatttgagcaagaagacacccagaccggtgaatatattgtggatagcgataatcgggcttgccccaggaatagaacacctcgacgtccggggggaagtcagacgccgcttcgaagtcgagaacaaagtcaaacttcttcaagatggctttctggtagtaatgcttgtccggttttccttgctgcgagaaggacgttgcgttgaatgacagaggagccggcggttctggaggctcgaccttgagcttcacccgataaagcttcctgaaaggttgcattttaacgatggctgaggcctctgcaatcggcacctgaacaagtttcaacccgtacttctccgcagtcgcagcccaagatacgaccgcatcttcgatgagttttggcgtcgcgttcatccagctcagttcgatatggaaacagttatcgggattgtgtagcctgtcataatggagatcgataacttccggccgatgcgagcgttttcggggatcaacatcatacttcatcgacttcgagagcattatcgccactttatttttggactttgacggcgtgtttgtcaccgacgtagccgcctcatccctactatccgacctcgtatgttccccactgggagcatctttcgctgtctcgcctgacggggtcgacgggaccgatttctctggttttcgtgcaggaaaccagccactccgagactcgggcggtcgcgcgactcgatactcagcagcaatctggtagaagtaattcccatccctaaagttatgcctctgctcgacgtgctggaagaggccgtgcttcatgagctcgtttccaaactcgacggcttcctcccgggtgtcgatatccttaaagttctgcaatagccaggtcgtgaactcggagccgataaagcagttgtagtgcaatcgccaatgccaccttctgtccatcatgcgaacgcccttgtcgctctgtatcagctgcgccaatgacgacaagctgatattagacctttcgagcaactcagagtctggtaagagctgcgcaggcggattgtcaagtccgggatcagtcagcaagaccctgtcaagctcagcagcaacgacctctgaaggatttcgcgtttggtacatgatattcaacgggttctgatccttctttttccgcgctgtagtctggaaacgcttctcctccggtggaacgtatttatgccgctgccacaggtgtgtcagttggctaatgccgagtaggtggatctcttcctcattgtcctcattgaactggtgcatgtggcgtcgggaattcgctgggagatgcatgggtatgagcacatagcgagtccgccagaaccggagctgctttgttgggttcgtcaaatggtcgcggtgacccgcaagataattatcggcatagttccagttgtattcttcggtggatgattgcagttgcacgttgctcaactcgtactccttgctcaaaatcgtccggatggcggccgtataggtcgaagtgtctcttttctcgaacggtgaaggagatggagtcagacgggtaaatttcgtaacttcaatctccccaccagcgacgcacactagtcgatgaatgacattacccttggaaagaaatatggttgcttcgtctcttccaaggccccgcggatcaaagacattcagcgattctaacgcatactgcccagaagcttctgctacagcactcccaaccacgatttggaatccgtgcgaaagtcgcaatgcaaccatttcacgaagaatagcatctcgagctttagatgcatcaccgccctcatgttcgtcgtttgggaagaccctatacggcgtttgcaggtaatcggtggcaagttcctgactggttgggaattcctccgtagttaatggcaacacagcaggagtcttcaagcttttccacttcacgaccgcgacatgcggtggtcttggataagcatgttgccaacgtccaaaccaactggcatccctcagggccgctttgggggtatttgacggattaatggatctgacccacggagctaatgccttattattattattattattataatcaggtttaacgtccataccgagcctttcggctatgacagaccccgattcttgggcagaagcccctattagtccctaatcccatctttggccattctgaaccttttcctcgccccaggccgcctagttgcgtagggcttttgggcctttataagccctccttgttgccagtgtcagtatgggtgtcgcctgcctactgcaggccaccctcccctattatccttctccctcacgttctgcctcctctagggctgccagcccccattcatcatccttccgtgtcctctcggctgctccccctttatacttgtgagaggtcgttcgaggaagagcccttcgccaggtaggccgttgtctcaaggagaagagacccgggtcagtcagaccgtcgcgtgctcgtgaacgacatagagtcaggaagactccttgatccttccctaaccaccattgctaagtatcgacgactacggttggacccagcgcgtaacaagtagctggctataaagcagcatctaggggttgctgctaggctatatcttagctataggctttttaccttctgtagctatattttttttagtagctactatagccttagtagcttctataatagttgccctaggtataactgtagccttagtagcttctatagctatgcctaggccttaggtttctagataagggctgtttaggattaaataggtcctatcggtcagattaatcagggtaaaaagtagcatttttaatatttgaggttaagaaatagtttatatttaaaaaagattacttgcagattagtttatatagtctgcttaagaggtcattagattataaaattttatagaatctatagatctaaggtttttatataggctctatagtctgttattcactacagactgcaaattgtagtaaatttgattatataatgtagtcaccttatagttattattctctattgctggctgtagcaattttattgatattcctaggccatagtttacagtcacatgatgcccgtaatgtaattggttccccttcaagccacctgagcgaagcgagggatcaaaggcttgtaactagtaggacaacgtagcctaaggttcaatatgcgaaatcaattcaagaaagacaaatcgaaatacgcctcccgtcatatgaaactctcgacatacaaacatagttcacgtataatcaatgtaccgatcctcctcatgagcaagttcatacactggatggataagcaggcggggtagagacaaggttatcaagagcagccaatcaatgatactgatagcaaaacatccatgtagagccgttccctcgttatttgtacttccattatttgtgtcttcgtaaatatccatgtatcgagatcgagggcaaaggaaagagcgggaaaagctagatagattgtcgagtagttgcattcatgattgtcctcaattctcccatgcttcaatctcccgcctctaccacattctaccgataatatgaagcgggatttgagttaatagagctcgtctgtggtggctggtagggctggtacccccctccagcttgttgacctgcattcaacgccggatatggagtgggttgcggactgcttgttggaatcgggggtggttgttgcgtgggcggcggttgatgtgccggggctgttgaggtaggatatggcggttgttgctgctgagaagggtactgatgccgtggttgaggagcgttatcctcaggagagtacactgacggcgaatgttcttggttttgctgcggcgggtggtgcggagggccttgctgcaacgcagcaccgggctggtacgaatgacgctgttcgacaggtgaatcatagatcgaggttcccagctcttgtggatgctcgtatgtcgactgcggacggtgatgcacaggttgataggagtctgaagggggtggctgttgaaatggccgacttccagttggcgtctggtttcgcggatcaggagactgcgcggccgtacgatagggaagtgactgttccgctccataatagttggatccgttaggctgagctggttgagacggttgagagtctggttttgaagctgaagttaatcatcatcgccaaaaaaaaaagaaatcaaggaaccaaaaaaaaaacaaaccttgagggcgcggactgtagtatcgttgaggatcatgctgcgcagggccttgagcgtatgcttgtggtcctcccactggaggataggggtatgcctgctgtcccggcctcccatactgtggttggactgagtgtgacattgatgcctcaagtaaggcctcataatctctccgtgctttgatgaatttctcattgagctgcgtgaattcatctgatatggaatattagcaatgactctggaatggaattctgtcaggcctacctttcttttgagagtattttccaatcagttcaatcaacttgggtcggatagcgagggtagaatgatagaggtttgtgatttcctcattatcctggacattaagctcagaactgttcgtgcttaaaagcgtcaacagcttctcaacgttcttgatctgtccgaaaacttcagcctccatctgtgcttcccgctgcaagtcttccggcgtggggtcaggcagcttttccacatagttcaatgggaaaatccccgtctggcctcgcaatgatcccttccaccaatctttataaaccgattccagaacgaggatgatgtccccctttctaaactgaagctcccccggttcagaaggctggaagtcgtatagcgccctcactcttgagactgttgatgctgccgtccctgaaggaatagcctgggaggtagtggtttgcggttgacttgttgacgctgaggtcgaaggtgcaggagcctgagactcctctgatggtcccgcaccagatttgtctttgatggacagcgcaagtgccatttgcaactcctcttcctctctctgccggtcgagttcggtgatctcgcgctttgtaggcttcgacgggggctgtaggtttggatctagcggagtatcagtaaaacatatcctttccaggaattctgtctgcggtactaactttgcgtctttaatttcacgtatgcctgctccatgataccaaaatccgggttgctggagaacatctccgtccattcctccatgcgctccagaattttggatttgacttgctggtgagtgttctatgcattccaggatagtgtcagaaaatgccacagcactgtccccagaatcgagggttgtcttacgcggtcgtttgctaggcgcaacagggcctcagtgaagctgcgcgatgccagctcgcgatggattttgggtccacagttttgtgccagggcattcgcaagctaagaagaagaagtcagaatcgacgattcaataatgtctcgatcgacaatacagacctctaacgtgtagagctgcacgttcgcatttcggtgcgcaagcctcttaatcaaagcagcaaccgcatctttggacctgtgaagacggcacggtatgtcagttccctatcgctctgacaatttgagctggccaggcatcgcagtcggacgagaatgacataccccgaatcttccgcattgactttatcgcagacatcctacaccacccagcagatgtacacgtcagcaccagtccagattgatcgcgaggatgaccagggtatcgcaaagaaataaggcggaggatgtcgtacgaggatgtattcccagttctcagaagtcaaattctcgtcagtcgctttggctgttcagataagaccaggtcagcgtaatccagttaaggaccctcccctaggaaatggtggtcacaatgttcccttcaggacgatcaaacactgtagccaaagacaaatgactcaccgactatgtcgtcaaaggcattctgctgggtgcgaaacatggcgtcgtctctcccccagccgcagtcagccttgatttctccgcgttcaggtgtggtgttatctcccacgccgcactccgggatgtctataggatatcggctccgatcagctgcgaggaagcgctccggagcaattcgaatgtcgttgtcgccgtgttgcctcctctagccgccgcggtgtctgatccgcaaaggtgagcaacagtcttgcttgggaagcgaagcgcaggccacccaggaccgtgtgctccaggaactcgacttgaggtgcagtgtgcttccaccaagacaggatacccgaacgctagcgattcactttatagctggaattgtactgcaacaggacaaggcagcgatgatctcaattgattcggggctgaggtcgaaatgctgcaacctaattaacagtcgtccgcgagcgggccagcgatcacgtaggcggagagcaacacagccactaagagctgagcgccgatcggcatcccaccttgggcccatgcgttccattggtggcctgttttgctgtcaatttcatggattgccgcctacaacctcgaagcagctggaaacgctttctcggtatcgcagcgtttgcgctgcaaagtcgcactcttcaactcatctgtggctaaacataaaaaagtaggtggatatattattagatttagatgagagaagcctctactctctagccagtgctttaattaatagacacataatctaagggtcgtcatcccacctgtaaaatgccaatgatcacatcgcctgaacgcctggttgacaacaccacaggcagagttcgatcgacagttaagggacacgcgcatgtctaaccgaacttgactgactcgatggcatgccccgtgttctattgaacacaaaattgtgattaaaaggagcgacattcgcagagttaagttacagagacttccattcatgcagcgttgcaagcaagatcgatacggcaagtcatagcactcctggaactattagagtcggcgactccacacaaaccctttctgttcccccgaggaagtaaactgaaattgataagaaaatcacctggctgcgacaagaccgcaacagacgccttcacatatttatctacaataaagaagaggtaataaccaaccatccaatcagcacccagattcattactgcatacctcggcagtacctaaaaaaggccataaaaactagaatgaaagtacattacatgacaacctgattatgcataatggtatcattccgtcgtaagtcaggacgccaaagttcccccccataagacgcctatccatgaaaaaaaaaagcaaaaaaaaaaagatgatgaaagagatggttggctaaccacttgcttcgccacaccaaggtcatgaactcaattgtctcattgtagccgcttagtccacactgggcgggagattcttgaggtactcccaaccaaactcctcctccggtttctccggctccataccgagggcgctacggtaagcacgaacttcgttctggagtccagagataatgcgagtcgggaggtcgtcctcctcgcaacgcaggcggtaggcggtgcgaatcatttcagcacacttcatcgtctgggcatgccagtaatcacggtcaagacggctcgccaggtgggcgtcacgctccgcctggagaagattattgtagtggcgcttctgcgcaaggaactgcatgttgttgttctggcaatagttgcgaatctgctcaacgatggtccccaacgtcgcctcgaattccccaatcagcttggcattttcggcctgttcacgcctcaggagctcgttaagacgacgttctttcgcgagggcgcgttcgagctcagcaatacgggcagctgcatctgtcagtccgtcgccatcacctctactcctcacattagacgtaccgctgatttcgccgttgacctgctgcaggttgggactcgcaccttccgcggtggagcgacgctgatccacaagtcagctatccatccattcatcattccaatctggtaaaaaaaatgtagatagaagctagacgtgttgaacgggaaatacataccatgatctcctcggcactgttgataataccacgagtcatctcacgattgtgcttcagcacatcgctgagttcaacgaccatttcgtagagatgattgagatccatctggtgacccgcgttcatcggaaccccagcagacattcctcccccaccgttgggctgggaaatgccgtgctgaggcgacggagagggcgtctggcgagacatgttggccatgcttgaagagttaggcgagttgtcgatgaaaccaggcattccagcaccattcgaggacatactctcacgacagaagtcgtcgtcgataacagcggtggaagtccggccttcaggacgcggaatcaggggagtttccgcttccctgtcagcgtcccctggctgtcccaagaccgcctttcgaactttgaggatgtcagcagcagcgacgagagaccttagacgccggtgaacacgaaaacggcagggtggagggacggggttgctggtcttctcagcaccctggttgtcttcgatatgtttgatctcgatgcccgtggactcgcctgtctccaagtccccgcgaatcagaccagccgccgtgtctgccgcagtcccaatcgggacaagcgccggagtctggagagtcatggtccgagcttagcgtcacgggcagtgggtggtccgtgcagagctgaccgcctgcctggagaggaatattgatagcaggcaggatggacagggatgaaagggtgcaggggaagagtgaaatccacaaatggaatggatcacatccttcacttgtggtggctagtgaagaatgcctacaacctagtaaagaggggctgcacgctttcgccagcatagacagtttacgacaataattcttagtgtctgagaagtgagaacagtgattccttgaaagatttcctatccacttatttgcttgaatcctttgtttaccccaaggatgctgaaagtaaatatgcattccttgggtttcatgaagggttcataatatatctccctggcggagggaaaggagaagtggctatgggccagaccgaaggcacatcataataacggaatgatgggaacaagtctatcattcgtttttcaagtcatatccagcacagccgcgagcttctggtcagggtctgtcgaaggtaccattgctgactggtcttcccgctgaatctccctgccctgactgagccggccagccaccctcgcgaccaatattctcatcttgtccagttcctgagtaagttcaccatctctggtgattagatttggctgaatattcttcagtggatctttgaaaggctccaagagtgcctcaagctgcttatactgggccagtcgccgtcgttgctgttgtcgcttagcatccaactcaatgagcctcttgcgtaattggtcatatctaaacaggcgttagtaaacaaagaggggaaattgattaaataataatgtattaccttcgtcgttcctcggatccgacatcttctgcttgccattcggtaggcaatctctcaataattctagacgcaacatcagcgccggtccatacccagtctaagcgaatttccaaaataaaagggtaggatgcctacagatgatttgacagatctgctccgacttcaattccagtcaaattgctttccggattggcagcatctttcttgatggtatcccaatatagactttcaatctgtcgcgcgacatgatgtattgcttggttggagtagacgacccgattgtgttgtcttaatatcgtatttactgttgcataaattagttaaaacaatcacaaaaggagaatcaagagtaatctggtgtctctgtaccaacatttctgtaaagcttcctcaactaccttctcgctgagatcctcttccgaatccggagcatagtccctccaaccctcctggggcgcgagagctgcagtcaggatctggacctggcttctaataaataaagacttcaactctgaaatcgttcgcgaagcctccatgatcttgcatgtcggaacccctcacatcttggacagtacgcgtctttgatgatctttccgcgtggcggctgcgatttgcgatcgataactgatcacgtgatgatagcaaccggccccactccgttggctgaggatccaaccatcaattggagccacggtcatcggctctggggtcgtcgtcgagctgctttcgacggagttcagctgtggacagtcgaatggaagtttgatgttgcagcacgagatgtcgaatgaggtcctattcagatttcaccccgctctttgaagaacaattatcacatctgtgcacgggttttcgatgttgtcaaataagccctttcccagataacctcggcaactttaatatatatctggctatcaacgaccaacaaatagggtccgaatctcatactgccgctccaaaagcatacattacaattcttctaaacaaaaaagaagatttgaatcgtttgcggctctagactctacctaccttgagttgcactcgcaatggctggagacgagcgccctcgggttctcctgtttgatattggcggagtttgtgtgagttgcaccaagaccaatggtgagaaattgaacaaataaattaacagaccttcaggtgtgctcgccattccaagcgattctagactacgaactcgcaaacaacatcccaccaggatgggtgaacttcagcatctcacggactgcgcccaatggcagttggcataagctggagcgaggcgagatcaagatggatgcagatttcttttcagccttcagccaggatctccggaggccagagctctggaaggaattccacgagcgtcttcgcagaaaacagaatcccccgaagacatcagaatctcttcctcccgtgcctgaggtcgacggggaatcactcttttgggagatgatgcgagtgtctcgcgaaccagatccacacatgtttcctgcgctgaagaagctcagagcttcgggccaattcctgatcggtgcactatcaaatacggcaatctttcccgaaggacatccttacaacgaggatgcatctggagtcagatcacagttcgacttcttcatttcttccgcacatgttggcctaagaaagccagaccctaggatatatgagctcgcgctgaagacgataaaggaacactcaaccagccgaggagtgacagatatccgcccttccgatgtcctctttctcgatgacattggagaaaatctgaaggcggcgaagaaggcggggatgagaacgttgaaagtaaacctcggcaggacacaggacgcggtcaaggaactggaacagataactggcatcccattgctggagagccaagatagacctaaattgtagatttagaaaagcgtcttgtatacgcttaacgaattttaaccttcaatcagaagccttgtattgtatttactagtatagtccataaatccgttcgctgggcgggattgcatgcaccactgcggatatcagaggggcttcttgcgatgagctttggtactgttcttcggggattattccagagcagctccagtatctttccagaaaggattcactatgtcttataatttattggctcgaattctcggttccttgggcgaaaattgttgttcgtcacccaccctaatttttttgcttggggctcgtggccgacccggatgtcaactccgcttttggatggccatcgcgctaagcgaagccgcgcccgcacaaattcgtcccgcacaattcccttgtcgcaactttttttccttgtccacgcagccaccgtcgacaacacataggcttcagtccttgtctcctcgacaaccgtcaagatggtgagtctcactgcatctgcagatggctgatatgcctctctgcaaaattctttctgttgcaattttacgggtctctgcaagatgcttcggatggagggggtcttctgaagcgcaaattgctgactcgtgtgattctttttgcagcctttccacaagctcgtgaagaacagcgcgtactacaggtgagctttactcgatcccttattccatgagatctgctgctaatgctgtcgcagtcgcttccagaccaagtacaagcgccgccggcaaggcaagaccgactactacgcccgcaagcgcctcatcacccaggccaagaacaagtatggcgcgcccaagtaccgcatggttgtccgcttcaccaaccgggacatcatcactcagatcgtgactgccgagatctcgggtgacaaggtcttcgccagcgcctactctcacgagctcaagcgctatggcatcaagcacggtcttaccaactgggctgctgcctatgctaccggtctcctgctggctcgtcgtaccctgaagaagcttggtctggatgaggacttcaagggtgttgaggagcctgatggagagtacactctgactgaggctgttgagaccgacgagggcacccgccgtcccttcaaggtcttccttgatgtcggtcttgcccgtacctccacaggtgcccgtgtctttggtgccatgaagggtgcctctgacggtggtctctacatcccccactcggagagccgtttccctggctacgacattgaaaccaaggagctcgactccgaggttctgcgcaagtacatcttcggtggccacgttgcggagtacatggagacccttgccgacgatgatgaggagcgcttccactctcagttccagaagtacattgaggacgagatcgacgctggtgacctcgaggacatctacgccgaggcgcacaagcagatccgggaggacccgttcaggaaggacccggaggagggcccgaagaagtccaaggaggagtggaaggaggagagcaagaagtaccgcacgcccaagctgcctcgcgaggtcaagaaggctcgtgtgcaggagaagatccgccaactggctggttaagtggcaggttcaagaattgcccattttcttcaatattcctagtggccagaaaaagcaaagacaccaggtctcagaaattgcaaaacaaaaaagcgggtttcttcgatatgtcgtatgatgtcctaatttcctgtatcagcgtcatggatcatgggatcagcgttatgtcatgtaatgggtttcttcggagcaaatagttcgggtataccaagggagcatcagttcaaccagttctgaatcgaatgcccgaatatgcttcgtggattcgtagaatgcccacaagtatttcatagtcgcgtagacgccatcagggcctagagtattcattccctgggtttcgccttacaggggactcgcattgtgtgaccccacaaaactagattctagtacggaagtactggtacagtattgggcgtgaccagtcatttagctggggcaatcctttcccctcaggaattttaagctaaggcatcgttctgcattttatctgcacgtgcactttgtctagctaataacccctcaagcgatggattccaaggctgtgccccggcacaccggggggagacgcaatggtctcgtgaccgagcttggttgaagcgggtggtacacgtgcaacggcaaagtgccaactatgtacgacttaagtcccacagcgtcgagtccaatgcagtacaattacatcaacaaatatgtcgtttcatcattgaaggaaatagcatagccaagctgaatgctgtgtaacgttctgtgcatgttcatagagtgcttgctgcgccttggtgcagtgcaggcagggcgttcctagatcgcgattgtggggtcgagtggagaggagatcccatagatgcggttctcaaagtcgggagagtgccctttctccccttcgtagtaattatttgactgcataagctacctacagagtgccacagttgagcatatagacactgtaccgaatatttcgagtatagatactgtgctaatagctctaagtccgtggtaaagctagaggtcacagtattcttgcctccacagctcgcatcgtgcccattccgttatgtaaagcgtcggacagcagctgcaggaagcagagaaaggtggattgtggcatttggaggcacgagtcagacaatcgctgcattattcccagtgccattccccctacccaaggaggtagccacctgcagggctgccagtgcccaccgaacgctggaacgccacccaccacctgacgaccgacctggttacccagttgggacttccccctcccagccagcctctccggccagtcaggccgttgccgcgagttgggtcccaaggactattagcttcttgctcctccggactccgtcctggtctctgtaggcgtacggaaggtccgacctagcctggtgatcccaccagccgcctcagcctttttagccctgtttctcttctcatcgctgcattgccgcttgccccagaatatcatcccttctttgtcctcgtcttttgtctttcatcttgccatcgacatcctcccatcgcgtccgcatcaagaccatgctcgcttccttccgccgccctccgatgacggaacggccgctgctgcagcatcagtgacgattctccggcgcaggagcaaactttggacccaccgacagtctatactccgtctcgtttattttggcctctttggcctctttttttgtatttctggcggaaaggatatatattcgaagcatacagattatatatatcattcattcttgcgcccctctacgttgttaggtgccacatgaggatgcggatcggcaaggaataacgtcacctgcgctccgctcgcattcccccagcgatctcccggagacttcagcttcccttgccgtcttctcactattacccgcctttcatttaccgtcagagtacgcaatggaggctgttgagagcgtggatgtgagttggcttcatcattctcatcgaggtatgcatcgttcagccagcttccaacctcgatgcacttcatttctttgtagaagcttcagcttttgctgatactgatttttccttgcgtcgacttcagatcatctatctcgaacgaaatctgcctcgtcaacaattgccgagaaacaaaacggacatgctgagacgtcgcctcagcagcagtcgcaagggaagtccgctggcggcaccgggtcgacatccggatcggaacagtccatcaccgggtcttcttcgacagaaagccatcgcgaaaacacgccattagatgtgaaatctgggaccgaaaatgacaatgccggagaacagaaggcatccaatacttcaaatgccacctccaaggggagtgcgccaagggctataccgataaacaggcgcaattcgtggatctcgtccctgagctcgagattctcctccggatctacgccaccgtcccaaaataatttcaaggagagccccccaaatccaaaacagagtcctccggcgacaaaattggaccagtataatccattcggtgccgctttttcccctaaagacaaggacgagaggaacaatgactcctcgaatcctttcacgtctagctcaccaaagaatccgtcgttctttcaaaacgctcttcggaagctgtcgtccggaaatgctggcctggggagggggtcaaataacggtacagtctgtcaacgtcgcgtgatgaacatcgaccccaatcgcgaccgatgcagggttcccgaattgaatcaggcgaaattgaagcgtgtggctttctgtgtggatgtagaaatcgccggattctctcccagagaggacgactatgacacgaacgatggacagcgcgacgccaatcaatcccagaatcctaaaacgctgtcctttagaaaatcggagaagtcaaaagacaaaggcgatgggtcgactttgaagaatcaccagacgtcggccccggtgaaggaaagagcgagcaaggtgccggaaaggagaccaagcagggtgcatccgttaatggcgaacacaagacagagggtccggtcaaggagcccactaggaaacaagagaaaaagaaacggtcggaggaagagcgaaaggaacgtaaagaacggaaacgaaggcaggctgaggcaaacggcactgtgccattacaattgacgtttgacgatgattcccgagcgtcaacgtcgggcggctcccattcaagagggcaaagccatcctaccactgatccagtccgaatttaccgacgctgttgccaacttcgtgaaactcccgttttgaagaagctcgttgaccggatgacttcccaatcctcgacgctggtggaaactccaggcaccgttccggtgttagatctcacggacttccccatgacactacaggacatcatcacattcagcgactggcttgcaattgttcctgttcgaaagctaatcctcgaaaattgtgctctcaccgatgagggtgtccggtcaatcctggcaggcctcctttcgaccaagacgatggagcaagcgaggaatcaccgaagatcgacaaagaagaatcaatctgcagccaaggaggacggatttggggtcgtggagaagttgtctttaaaaaacaaccctaagattggtcctgaaggctggcgtcatatcgctctctttgtccatttgtcgaagtcgatcaaggccattgatctctccggcattccgtttccaaaggcgccggcggccaccaatggacctgcggtcaggtctgcgaagcctgcgacagatatcgcttctacgctggctagtgcactcgcaaaccggttcggcgggaaccgcttggaggaactgctgctcagcgagtgcatgccgtccacggacgatgtggcaaagatctgtgatgccgcgatctcctttggactgaggagattggggctagccaacaacaacttgacccgcgaaggactcgaacatgtcgctcggtatttccgatctgggacgtgcgaggggcttgacctgggtgggaacgatttgagagaccatatggatgtccttctccctgcaataaacgacaataaccctatcatggcactgagtttggccgattgctcgttgaatcccgctgccatgtttccgcttctccaagcgttacctcgtctaccgaacttgcgattcatcgatctctcgcataacccagacctcttttcaacgcagccagatgcgttatccatgctcaggagattccttcctaagatgcctttcctgagacgcatccatttggcggacgtcaatctctcgcccgatcatgcgatcgcgcttgccgaggtcctcccagagtgccctagtctctgtcacctgaacattctggagaatccaaaaatcgtgagcttgacgtcggcgactgaccctgcgagtcaggaggaggcttgcgccgtatatgcctccctgatggctgccgtacgcgtctcgcgtaccatcattgctgtggacatcgaagttcccagcgcagaaagcagcgaagtcgtcaaggcgttggcatcacagattgtggcctattccctgcggaatctcggtgccctcgaggaactgaagggttcagacgatgcgtctgctgcccgatcgcaggttccggttccagaagttctccagcatatcgtgggccaggttgatggaacgctatgtgatggtaccgaaattgagcctgctccggatgaggactatgtcattggtggcaccggggttgtgaaagcactgggagtttgtcttggtaatgtcgaccaccattatcgtgaactgggcgatctgtctcggcctaccagtggcagatcgactcctgtgcatcgacctacatcttccctcggtagcaccaagaagccccgtgacatgtccataaacctgctgggttctgcacggaacattcgggcgaggattcaatcggctcttgtccgggaagacaaagccggcaatgataataattatcgtaagtttcctcatgtcaaaggccttcccccccctcttcttttcatgctgacgagttgcgtctaggacgtctccaatttctcgacgtcacgctggagaagattatccagcgattcgaagacgaataccctgagaccagaattgggcctcccactgggtccacggctggtggagaggtcggctcccaacactctagtgaggacgttcaagatcagtccttgttggctggaagtgttccggctgataccgctgtcgacgaaactgcaatcgatgaggaagacacggatcaatacgccgttcgcctatcacgcagtgggtcgaatacctccctccattctcgggctctcacctcggaagaaggccacattcaccgcatcggtcagaatctgcgtcgggatttactcgattcctctctgggaccgtctgccgatgggctgtccactgtcccggatgagactcgccttgctatattacggcagaagttggagagcttgcgcggagacgagatccgttcacgcgtggagagcgtgggcccggacaaggcccttgaagaactgggatccacggtcgaagaactttggatcatccagcggcaagaccaggaggcattccagaaattcaaggaaagccagatcgccgctcagatcaacggggggctgcgcccccctttggcagacgatagtcacccatcaggcaagggcttctgaggagccccaagccggagaagacacctcgtaggtgcgcgcatccattcgaacaacgaaatggattttcttggtggcattggattcatctcctctgccgtgtctgggtttgcttcgcctctgatgtgtccggggagttgatgctgcggtcgatactccgcgggcatctgcagtccctttggcactatcgaggtcacctgtacactttcccttgttggtgatgttccgagcgtctttgtatgctgctctgtgatgatatgtgacttttgtaatgagagatgactgggtctattgtaaatgttgcgactgtgcgtttggggtttgcaagggtttgattttttttttgggttctgatatggccgcagctctcctagcagagcaaccctgactctggtttggctactgcaccgataccaatctggttttctttgtggtctatgtattctcatctcatctatgtgtaatcttacagaatctgtcgattcgaggatccacttgtttcagttcttgttgagatctcgaacactttctctcccatatagatgggtacatccatgcatgtgacagacggtcttttcatccggttgcttctcgtgcaggtcttgaccatcttgcagtaggatggaatctattcaactgtaatgaaagaacaacagagatctacatacggcattttcattctgtccacgtgtccattgatgttcctgttgatgtcggccattatgattatatttatcataatcatcaatgctctgtaactagttagtccacagggttacgtcatctcccgcatgctggggtgccttatattattccggcacgtgattgctccattggaaggttgggtttggaatccatggtgtaactcataaaaactgggtaatcaatctgcacaatggtaactgaggcttatcaaccaaataatgggaatgggggccaccaggcagggtggtgctgatattcattgctgccccaggagttgttatcctcggctgtgggggaaccgcctgccagaccggatcagctgcggcagcttcacatgtcaaaaacacaacgcggcaccagagtgtcctgccaccatcaatttcggtccaggtttattcctttcttgtcgccattctgccaaatgacgcggcaggtcttctcctctcagcccgtcgatgaccttgcctctggaaatctcgtttgttgagtgctaccatggctgcgcaatccaagctgctccctccggagcgctccatccgacagatcgtctcgcacctgacgggcctgtatgttagacaccgcacccgcatctcgcgcgctgtctacctcgccctcttcctcgcgctcgcccaccgcattcgcaatgccatcgcagagcaaaaggccgcctctcagcgacaagaagagctgcgggcccggccagggaccagcactctcggtgacgaaggcgcgggcgcgaccaggaagagggtcgagctgaatcgcgagtttttgcgaaacttgcttcgccttctgaagatcgtgatacccggctggcgcagcaaggagtttcggctgctcatcagccacagcatcttcctcgtgctgcggacaatgctcagtttgtatgtcgctgaactcgacggcaggctggtcagcaacctggtccgtggcaagggtaaggacttcttgtctggtctcgtgtggtggatgacagtagccattccctcgacctttacaaattccatggtaagtgcgaaataacagactagctggtgtggtgttcaaatctggctgacctgggacagctctcataccaccagtgtcggctggcgttgcagtacaggaagcgcttgaccgaccacgtgcatgacaaatacctgtccaacatgaccttctacgccctttcggctctggacgatcgcatcaagaacccggatcaactcgtcaccgtcgacatctcccgtttctctgacagcctggcggagttgtattcgaacctggcgaagcccatcctggacatgatcatctacaattacaagctttctcaaaacgtcgggatggagggtcttttcctgatgagtcttttggtccagctgtcggccaatgtgatgcgcatgctgacgccgccgttcgggaaatacgtcgctgatgaggctcggctggagggagagttcaggttccagcacacgagactgattgactacagtgaggaaattgcgttgtatcgcggccacgaggcggagaaagacaacctggataagggctatttcacgctgatcaagcatgtgaaccgcatcctgcgccggcggctgtaccatggtttcatggaagactttgtcatcaaatatttctggggtgctctggggcttattctatgcagtattccagtcttctttaagattcctggccaggtcggcaagacaatgggggataggacggaaagtaagttgtctcgcaatctaaggtgacgggagtaattctaacatgtgacaggctttgtcaccaatcggcgattgctcctctcttcgtcggatgcctttggccgtgtgatgttctcttacaaggagatctccgagcttgcggggcacaccgcgcgggtttcctctctgctggacgtgatggaggacgtggcagctggacggttcgagaagaagttggtttcgtcggcctcgacagacgaaaatgcagcagtcctcgctggccggggaactgtggtggagagcgaatcgatcgagtttatcgacgttccaatcgtctcgcccaacggcgacgtccttgtccggaagctttcctttactgtgcatcccggtgaccatctcttgatcgttgggcctaatggttgcgggaaatcgtccttgttccgcattcttggtggcttgtggcctgtctatggaggcacggtcaagaaaccaagctccgaggacatcttctacatcccccagcgaccgtatctgtctcgtgggacacttcgccagcaggtgatctatccggacggcgttcgcgaaatgcgggccaagggtgtcactgattcggatcttcttgaaatcctatctatcctagaaatatcatcgattgtcgatcgcccaggaggatgggacgctgaagaggagtggcgggacgttctgtcagcggggctgcagcagcggatcgccatggctaggcttttctaccacaagccgaaattcgccattctcgatgagtgtacgtcatcagtaacattggagatcgagaaagtcatgtatgagaccgccaagagactcggtattacgctgatgacggtatctcaccgtcgcagcttgtggaagtatcacaagaagatcctgcagtttgacggtcagggtggctatattttcaccgggttgaactgggaaaggagactgaagcttgaagagtaagcaacttttccttctatgtcattatctctgcgagaatataaagctaatgcttttctagtgagaaggaggagctcgacctccagctgcgcgcggtaccagaaatcgaaaagcgcattgccgaactgaccgcagcgtaagcccttattcaacaatatatctggctttatgagcgctattttccggtgtggagacgcgtcaagatacgtagtgaaaacaatcaaaggattgtcgcgaagtctttatctactgaagtcttcgggtgtccttttgaacaaagagagacctcctgtcaacaatcgccaactgggagctagagcgttctttcactgtcaattctttcatccgcggtttccgactcctggacgctttcatttgggatccatctcattgatggtgaagctcaggggttggattatccatcgacaatgagggttgttctttgaagctttcaaggatgcattggatatcacatctctttgctgatcgtgtcacctagctccctacgtcatcgttcatgcgatatctcacatccatcatgggtgcacaattttcagtccctcgatcagaatgtacagtaacggttcgaatcgatcaatgcagcaccaaccatcgttccaccgtcgaatgttctatggagcttcctctcaaccgtgcgtttgagattgacattgtcaacaatctcccaaaccgcaaaggaagatgcgcgacgacgatcgcgaactcttctgcacctgctctcgcctgcgaaggtgaaactctcctgtcgccagcatcaccggagtccataacagctagtcctatccttactccgacgacatggacaaggacattatcagcacattccgcaacaggaagcgctatcagttcccgtccagttggcctccgtcgacgcgaggatgctgcaagaggcatgctgattggtatcaagatcatgacaggcgagattcgaattcgatcgtcactacacgacggcgtccacgaggaggaaaaaacgagtgaacgaatatccgagttggatgatgatgaatattctgcggaaaacaactctcattattaaattcatgcggttggttaccatagacagcagtcagactggttggtgcacatagaacgaaaaaaaaatacttgtacgaatactatctatctatatagatatatcctacaatcgagtcgagtcgaagcaattcgatctacaacgatccaatcaagcctgatagaataaaaatgataaataaatgacagaaggggaaaaaaaaaacaaaaatggaggattaacaaaggattaacaaaccttcctcactgcatgttgatatagactctgcatttcatcatgttactgataatcccaaattagagaaataaattgtagtctgttgtcgtctagttgtatgttatgtcatgcacagtacagtacacgttgacagttcctaagagtacttcttgtcccgaacaactcgtcgatacggccccttcccatcttcatctcgtttgaacaccaactccaaccgcccgtcgacctctgtctcgcgcacactgagcagtttcctgaacgtctccgtgtgctcgatcaccgcgcccgtattcttgagttcggcgctgggtgtcgagttcatcgccagcgccgtcagtcccgagatggtcgaccacgtgtgcgaggctctcatcgtgcctacagaatataacgcataggctaccgcgtacacgcagtacacaaacaggatcgctaatgctaccttgattgtgatcccgtctattatccaggcatatgttcctgggagatagccgtggatgggcaggatcacgccggttgggttgggttgttagacgttctcaccacctccggtaagcgtccacagctcgacgactcctgcggcgtgcgacagcccgtttgcgaccagggctgcgatgagtctctcgtgcagaaacggacgcccccagccgttggacgagtgggtgatggccgcgtcctgctggtagtagttcggcaggaaatctcctccgacaggacagatatagctcgtcagcggcaactggcccagcagaatgtcggctacggtgcggttgttaatgctcgtggttgggttcaacccctgctctgcccacgttttgctcatcgagatcgacggctgctgcgtccagcgaggcaccgtgacgaggtcatccggagacagcaggttttgcgccacgagtcccgtgtgcatcccgcttcctgggatattatgcatgtaggtggtcgtgttggcccattgtgctcccacgaggcatgccgacgtcgtcaggttggtctgatttgcgctacagaagtcaccctgcacgacgatggcgcccaacgccgtcccattgacgggactcgtcacagccacatcgtcgatccagataatccgcccctcgggcttctgccgtgcctgttccaagatctctctccggctgatggccgtatacgcaaccgtggctggaggcgggttcagggtatgggtcggttcgccgtacggttcagagttccagggacagtcattcccgtggcacccggcgatgtaggtggtgggaaagttgatcggatcttcatcatatttgtccctgatggtattcatcacacagtaggcgctggcgtacgcctgaggcatgtcaatcctggcatcgatgaccatcggcatcgcttcgtcgtacaattccggtttaccgtacacaagtttcccggcatacatttcaatgccaagttgcagagcaagggctacggggacatgttgaacggtaacaattgtgctgttgggcgcgtactggacgtatattgatcgggtcacctccggctccattcccgaatcgatccccgcccggggagtgtatgtggccatttgggacgagtagacatccggcatgatcatttccggcagcataccgccaaattgtttgttcgggacagacttgggctggacgccggtctgcgagtcttccagcgggggcaggtatgccagatactcccaccccgaggcaggggacgtctcggtaaagcgttcatcatacggatcggagtcatccgttggatcgacggatgagaagttggtcgaacgcaagacagtcgggtagaggatgtcgctggtgacattcaaggctacgccgtagtccggcagcgtgaaattgaccggccgcggctgcatggcgatcgcactggataggcccacggccgcagcgaggagagtgctgaaggcaacgaacagcaagaatgggaccttcacgaaggccggccaccccgaggccgtcaccgcggcccgaaattcgggagaccacagatagctcatctgggtgacctggtaagcgaagaagatggcgccgaacggcaatgggcgtcggccggtataggcgaccgcaacagtgacgatggacacctgcatgagcagctcgtgcactttggcgacgaactggagcgtggggatccaggtggcgttgtaggtgtagtagttgccgttgatgttgatcacgatgagggcgatggcgactccgatcgggatgctgtgcagcaggaagaaatccaggaatactctcgacccatagtcccagaccatcttgggccgttctgagggtttcttttgttgtcggccgctttttgatggtccttggaaggtccatcgtggtggccatgagcttctttgagaatgggttcttccgacgggtttagacttgtctgggcctcttcatcgctatataccaatcaatcaatatgtgattgatgcaaggtaaaaacaatggtccagtccacatacttgacatcgcaagtcaagtccgccgccatatggcgactgttattcagctcccgcgatccacggtcgatattccagttcctcctgcggtctctccctctccctctctctacgcgccgtctttcaacttttcatttctttgctcatcaccaagaatgaaaaaagagtagaaatccagggcaggtgaggaagagaagtcctttttatttttgaagtcgaaccctgcgggccggttaattagtacatctactcagccgcagggcttagcggttggttgatcgacagaaagcaataaatacctaatacgaagttagttcaagataaggggtaaatataccatccactctcacagaatactaacctggatgcaactaacaccttaagacctcttttgcataaaaaagaaagagaagaaacttacttcccacatagagagcaagacgactatcaggagcgaatataaaactgaatgaaggaatcatttcgtttcctgtcttcaaacaaccttgattattgtggctggatcgtgatcagtattggatacctagtgccaacagcaacaaaccagcatcaccacctgattggtcggatttgtcaatctataaatagggaaacttgaatggctgctcgtcaagatgcggtgcaaagacagaccaatcaggatccttgttgtctccgtccaacaacaaccttaacagttaatgcaactgtcagcaggggcggtctccaatggcggcgatgggtctaaggagacccagatagagtatgcacatgtatgatgtatattccatctagggagtatctatccgctgtccagagtactacactcaggacgagtgcctataatcagtgataggtcacgctaaagatttcaaacttgccaattttgttgccgtactggaccgtcccatcaacaccattctggacactcaggtacgtcgagttcgcgcccacttgcagccggtaaaggccgtttttctcgtatatgatggtgaacgcctgtgcggcatcagacgaattggtcagtttgggagaagacgaggaggcgatgtactgcctgtccacggcgctttggatggtgaacgtgttgctgccagcttcgagctcgtggataatccactgttgccggatgtcgtcgtgctgggctgtcgctggcgtgactgtgacggtcttgctgtcctggttggccagcgcaaggccttccgtctcgaaggtcaggtaccgaccttctgtcagggcgccgcgcaccggcttgaagccctcctccaccagcagcgtcaggttggcgtttgcgttggccggtccgtacggcaccggcggctgcgtctgcgggaattgcgcctggcatttggccgcgccgatgtagttgcctgtcagagagcccaggctcaagttgccgctgtactcgcttgagttgaggggttcggtcagaggggggattgccgccgcaatgttggggagtgagtagtcgggctagtaacaacgacaggttagataggttgattatatagattatctatatagtatatagagagatcgcaccttgtcaaagtcaaaggcattcaccaaattcgacatgtgctcgcgccgccacggcggaatttctttgctctgaacgccctggtatcccaaggcttccagccatgcttccaagaacaagatctgcgaggtgtggtcggcatgctctgtgaacacccggccaccgcgggtccatggagagatgatgtagaacggaatccggaagcctatgatattgtctctttaagcacatgtcacaataccctgtatcgatatatgtgtagacgcacctggtccgatgggtgtgtacccggcacttccatacggatcttcgatccattcacctgcggtcccatttggagcatggtagggcacgacatggtctccaaagccaccgacctctagacacaagttggtacgggatgcaaaacgcctctcgatacgatattcctaccatcgtaactgatcatcaagaccgtttcattgtagatagggctgttgatcacagcatcaaccacctgtttccgcaaccaggcgccatcgctgggcaagtagggggaacgctctgacaactcagccgggcctataatccaataacctggggcagtgtgccgtttttggcatccgcgtagaacttggccagtcccgggtaggagttaccatggatggtcagcggagaggtggcgttggagttctggtactgcacgaaatacgccagcatgttgtcctcgaagttgtcaaagtcctggtacacctgccaagtcaccccggcttcttccaggtattctgggatcgtcttccatgggaacggataacaattgagaagaggttcctcacaacctgggaatatacacatcaatactagatatctttcccatactgggtcatatcgtacttaccaggtgtggcattgttgtcgagaatcatgtcaccctccccatcagggttgttaggagtgcccggattgttcaccgtcccactcatccagacgacacggttcggatcagtggctgccataacagcttcctaaatttgtagattcgactaatcagcatggcttttatttatttttatttttcttttgtcagcggaaggcaaagacacacctgatacatgtcagccacggtccatccctcggcaatatcaaagtgaaccgggatgtcctctctcctgaaataaccccagctctggcgtattggttgccacccactggttgaccagaccaccgttgtatgcggcgtgcatggcctgccagctgttgtcccccgcgcccatacactgcgtggcattgcgccagtcgccgcccaggtagttgagataccagggtgttaggatggtggtgtcattgctctcggcaggagtgaccagtttaacatgtacataagcatcaactactggcgcggaatttgtggatattaattgacctacttactgttggaaagtgctgtgtccatccggattgacttggacgttcgggtcagcgaaaccgcggacaccggccatggttccaaaatactggacatgtcagaacctggtaatccacacggtcaaggaaagggtcttctaacgtggtcaaaggctctgttctcctgcatgaagagaacgacatgcttgatgtccttcagcgacccggccgaagcggcggttgcgagggaggccgcaaccacaacgacgctgttgggacgcatactgttcgatcagatatcagaaaggccagacttgtcgactgcgaggcagctgaatacctgaggagccagccatcttatatcgtctggacttgttacatcacccagatagtactctttctttctccgcctggcacgtgggctgctagccggcatcgatcggttgcagcacaccgagaagagctaacagggcaagtaggcaagtaacatggatgtcacctccctgctggggaggtagctagtcgttagttagtcttgtgccagcgacacggagagcaaggatggctgttctctaggatgcaatgtaatcaatttaatgcaatggatccccgctggcaccttgccatccggggaggatccgggtgtgccaatcagtccgtcacatgccctgtcagtccccatcgcatccatcttgttcatccagcacgacagagccaagtgatcccgctggatgatcctccccacacgtccagacgtgtctgatcaccctagcttggcaaaacaaacacctacctgagcaggcagttacatatccagacttcgacggtctggattgtctatcgagctggagcaataaatagcaaataggacaagaaaatacgaaaaaaaaaatcctgtttgcagtaatcaggacaccagctcttctcgatgaattgagaagacgaggaagaataatgcctcttcctactctgctgcgacagctcatgtccttcttcaaatcgtcgactttggatcccaaaaatgcgaccagacttcatgttcttgcgggcacagtcctgctcctgacggtattcggtctctacggtgcatactattcggccaaggtctcctcctccttgggtccttcgatcgacgaccaactttgcctcagcagaagaggaggacggtctcgcaaccgtgctgcatccggagcagcatgtctttcgtgatgccaggaccattcgactgcagtggaacatcacgctcggtcaacgtgcaccagacggcgtcacaaagcaggtctacctggtcaatggtgagctcacatcgtgcagctagtacagtgcgattgtggtaaaactggcgcaaggctaaataaattgaaacttgacagggcagtttccaggccctacgattgaggctcgatccggagacgagcttgtgatcgaggtgcagaactctttggaagatgacgaagacttggcgatccactggcatgggctctccacgagaggtcagtcatctgagacacgtgttttgatcccagggtaaataattactaatattttctaggagcaaatgaaaatggatggagtcgtaggactaactcaatgcgcaatcggcaaatcccagagctttacctatcgcttccagattgaagatagccaggctggcaccttctggtatgtcgacacatagtaaggcttgtactgtacatacatcgtgttcaacagcacgccgactcgtgatgactcacccaggtatcatgcacattccggagttcagcgtgtcgatggcctctatggcggcctggtggtacaccgtcctgctgcgcagagcacatccgagatgtcgacctatcagtacgatcgggaactgctacttctcgtcggcgattggtatcatcggcaggcgcacgaggtcttggattactacctggactggaagaactttggcattgaggttagtcttgtgagaagtgtatttgtccgattcaatccgcttgctgatatgaactgagcccagcccgctccggactctcttcttatcaatggagaaggccatttcaactgctcgatggctgttccggcgcgaccggtccaatgcgaacaggtttcggtaccgcagctgaaattcaacgacgggcgctctcgactgaaggtcgtcaatacggggttagtcgatttgagaaacacttacttccgagtctgtgcactaacgctttgcctttgatagagcattggctggattcacattatcgatgtcggggactgaaatgaagctgatccaagtagatggcgggaatactgtggctgacacaccccgtactgaatccattggcattctctatccaggcgagagaatggacatcatcatagagcgcgctggtagcactagcacccgagatagagagtcgacgttgaccgtcgccctagatcaagagtatgtataccattatccagtcaaccgggccaaacgtctcgactaagacaaagtgtgtgtgtactgagcatgtgcagacatttgaaattcaaaaactttgccctcactccgattcaatcgtttcccatttcgtggttaccatccacacagagtgcatcactagcaaatcgaacagaatcgatacatgtacatgttatacccttcctcagtttgggaaacataaccggccccgtcctgatgacggcggatgatatcccccagaaacaacccacacagacgtttgtgttgtacaccaagatcgagatcctcgccaaatacagaaatatccccaagggtttcgtgaatcgcacgtcctgggtggttgaagacgccaaggcaccgccactcctggcgcttgatcggagtgagtgggagaaacaaccgcaaaaggaaaagacgtatgtgccatgggcgacccagtctggggaagggcaatggatggatatcgttttgaataacctcgacgatagggggcatccatttcatctggtgagtgcgaaccaaatatcaactgaaaaagaaagggggcgggaagatgggagaagaagaggcagactaagctaatctatcgtgatcatcaaccgaccagcacggctacaacttctacgtcctctcctcccaccgctcccccagcggtcgctacgaggcatacaaccccttcaatcccaccgtggccgtccccgccggcgcgccgctggacacgctgcacccggtccgaaaggatactgtgtacgtgccccggatgggctacgtggtgttgcgcatgcccttgaacaacgacgggctgtggttcctgcactgccacaccatctggcaccaagcggttgggatgggcatcgcgttgcaggttggagaggctgcttctgctccgttggcggaggctaagtcgagagcaagcgctctttgtaattcgggttagagaggtggatatatgccattacatatctataatgaaaacgactgtgtacaagcaaatggtgattatttatttcattgttattgtttcacaactagctacagcaactatattcgcaatatatatccctctacaaaagtgcgcagggcaaagggcacagggtacaacagaatgaaatagagtaaatgtacgccccgcagatgattggctattatgaaaaagagatagattaaggagatcagggggtttcttttcgatgggtataaaaaaaaacaggggaagggggggggggggggtggggggaaactatactatattatacatatatcagattaattagtgcattgaccagggtacggggtagtggttggttggtcgcgaatgaataaatcatcaagcagcgcaaacaaatgatgttcggtcacatgtgttttcagggtatccaagtgtcatccaggcaggctattcacatgcagactgcctctggtagattgctctgtgagcgacgcttggactgggaagagtaccttgtcttgcctctcaggatcttcttcctggtgcttcttgaacccgtttccgtaaaatgaggcgacacttgacgctcagtcatgtgaaatcctgaatgacgagatgaaggtgtcagacaaatcgaccagcttcatttcatgacttcgagtcagaggtgctttgagattcagacggtgcgacaacttcggtactctttgcttcgggcgcttcagcctgatcatcctcgaccttggcaacctccgagttttccttgggtgcgggttctgaaacactggagctggatacgatagcttccgagctttcgctcttgccgtgtttcgtctcctgcgaccccgaagacggctcgtcagaagcgttttgtgtattagtttcccacggcggaacggtctttgacagcggcgactttggtagaggagcatcattcgtcgcaggttccaggccgccttcttcctttcggtgcggagataaggaatcgctccgatctttcttccggagaatggcactccaccgcttccttcgacttccacttctcgcaaggccagataaatcttcgctcctccgatgtggcgattgtgttcgcccccgatctgactcagctttctctgtgttggcaagcgttgtcgtcgaagatgatgtgagggacgaccgcggtggtgatgtggtcgtcggagaacttgatgcatttctccgctcttgccattccttgcgtcgctcactggcccatgcgctccaggagctgaagtatgcacccgctttctgactagctgcgctgacggaagcctgcgcttgggacagatccacagaaggtgccttgcgacctccaaaccaggagttcactgatattgagctccgtggagaatgaggcggtgaggtaacagactccttgtcctcggattgtcgctctgctgcttgctgtgccttctcttcgttctttttccgcatggcttcaatatctgcccagaagctactgaacaccgagctcatcttcttttgaccgcttgcaagatgcttgttcagcgcctcgcgaccctctcgcacgcgctcgtcaagatgcagctcagcaacctgttgcgtcagtcgtcgctggatgtcctcgatcgtgagtcctccagcacagggatgccggggctctacgatggagaagaggagtgcatccgacgtcaagcgcttgaagagagcatagttcgccgtcttttgccaccgtgctagaaattcggagttgaaatccaacgccgggtcaccctcaatatcgaacgtttgcgctttgatcttggagccggcttcggcgtttgtccccgacgtggattctagatggtcatgataattcatgcaggataacagtgcaagcaggtattcctcgaattgaagcctgataaactcctcagagcccatgtagccatgagttttgggttgccgcgggtgcgcgtcatcccacgtatcattgaccgcctgtgtcagaaaatcgatccaccgcctatctgccggggtgagagacaatgcgctccgtaaggagggagaggttatattgatggttccctcgtccagctgcggagtaatgttcagatcttatatttcagtaaaataggggatggcttcttacattaataaggatatcgctgtagcggtccttctgctgtaaaagcagcgaattcgtcgatcccacaacgtacgacttagttccgtgatctgcgagcaggtccagctgctgcaaaggtgtgtagggaccgaaaatactccccttggaaatgtcagacccgttcacattgcactttggaagaaacatcaatcagacctttccgaagatttgaaggggcagacccatgtatgcaagtactaaatgtgtgttagcagggaccccgggtcttgtggtgacagtctactcatacaagagctcctttcacttgtctttagagaacttggtttctcggcattctgggcgtagctgtcaaaggctgggtcggcacaatcttgaagattactgatgagaccgggtatcaaagaaatcaaagaaaattgtatcatgcataagcgttcgcatcgtgaaccaaaaaataacatctgtgtgttgatgagcaccatcattctcaaaagacaggtgctctccataccttgggctgtaatagaagacatttaaacagaacgagagtttgatatttaaattcgtggatcatttctcgtaaagagaggccttcatttcgattagcacgagcagaacatacctctgcaagatttcccagcgaaactcaccgaggtattgatctttccgtgcctcttcattcctcagactgactaacaggctctcccggaatttctagtcaccagcaatgagtatacgatatcacttcaagagttgaagtcaggtatacctttaggatgtcagtgtccgagaaatccctgtagttcgataaattccaacgtcagcctcagctttgtaaccgattcttgaatccaacaagcctgcagaggaaatcgccctgcaagtcccagcgtggcaatcgacaccgaaatccatattttaggcacgcctacgtttcaagcacatcgccgaggaacataccgctgcgcaaaccatgccgatgtcaccatcgacaacttctccctcagaggcccaaaatgttcagggctatcggtaacgacgacgaccgccttttgaaccgtcgacctcgtcacatcaggggggcgattaatcaacgtactggcatcgatctgcctcgtgcaagagatcccgaagagcgaagtcgccggttgcgagggagttgcgtcacgccggagtgtaaagtacgaaaagtcttcggtggatctacagaccagcttaacagtcagaagccgtaccatagagttttgagcaaggaaggggccagccaaatccgaattgaatgttgaatggtatatggggttgtcatacgcatgcgccccgtccgacaacgccatgaacggcaatagcgaccagtcgttctcggccgcaggatttgttccatcgtctccaaaacataactcgatctcagggcctctgcagaacaatatgaattattagcacgaattcacctgtcgtccccagtgctgtctcattgacctctccggacacaaataacatgtctcgtggaagcgaagtaataaagatggaacaggcagcactcacctagcatggtgaaagtctataaccaggacaacaggaccctggttggcagtggtttgtgccatgacctagatcggttcgacaggagagtggaagacgatgtggatcgcctggtgcaggctgacccttttctgcttgtcgctgtcgcgctctctcctctggtacttttcacaaaatgcgattcaacaagaaggctcaaatatgctgtgttgcaaccgactcttggtcgcggacagcacagcaaacattcactgacctgatgtaactgcgcgaccccgagcgcgtccaaccttgattggcttgggagccagggcggtgaagtcgtcggccatgcttcacatgcttggcattcggagatagggcggggtgtatccagcaagacaaaaagtacctgacacagctttttcgaagcagattaaatggattaataggatggattaattggtttgcattatattctctaccactggttgtcaactgcaagtccaaaaatatcccagacccttattcattaattagattcttcgatctattcttgacgcacacatcatatgaacataaccagtcccacgaaaagcgccctttctgcaaacctgcccattccatcatccattttcatgtagaaaacaacaaagtttaacagaagatgtcccctccctcctagatcttcccgtcaataacagccgacacgggctgtgccacgaagaaagtaggagaattgcgcagagtgcaaactggggaggggccgaaagaaagggggggaaaaaaaaatacgtgggctttcatgtacatgtcatctccgcagccaggcgaaaaaaggaaaaaaaaaatatagatcagatagctatcagatcgttctcgcctaatttttcaaaaggaaaaacaatacagggagctagaaacccccaacgtggtctagtagctccctacatcccatcatcctttgttgtctgagcctaagaaggagggggtgcagggccttggacctcgtccaaggacgtgacgctttgatcgatattatggtaatccaagatttccgagtacctgagaatgcggcgattagtaaatgccaatatgcaagacgaatatgcacgcacatcataattttccaggtatccactggtagatccgcatcgttaaaagaccagtcaaacttctcctccgcctctggttcatcggtcggatcatgataaggtgccaggtactcgtgggcgagggcatcgccagcccggattcgcttctttgggtcgaaaacgagcatcttctcgaggagatcgacggctgcaggacgtcagaacctagacaccccagttaactcaaacttggtgacacgcacctgcaggatccgcgttcttgaacttgttggccaatggttgccgctcgcgctttggcaaggattgaacgaatcgtaaggtctgcaaggggtgggggcagtcagctcctgtttgttacggacgagaagcaaggcagagcggatctcacattctcactgcaaatggtctggatcacatcatctggtggcgtgccaagaagttccgtaatgatggagaattggttgacatggtcctttcctgggaagagcggttttccatcgagcatctctgcgaatatgcatccagcactccaaatgtcgacctccacgtcgtacttctgccatgtgagcatgatttcgggggcacggtagtatctcgtcgagacgtagccggtcatctgaggatcttgaatgcgtgctagaccaaagtcgcagatcttgaggtcacagttctcgttgatcaggatgttgctgggcttgagatcacgatgcaccacaccggccgagtgaacatatttcaaccctcgctataaacggtcagagaacaagccacctcgaaatggggcggagatatggccacatactaatatttgatagaggaagtattgaatgaattgtttctctagcggccgtgacgtgaggagtcggtgcagatctgttcccagaagttcggtcacaaagtaactgtgaggggaaagtcaatacgctatgacggcatgtcgtcgaggcagagcttcacgtacatatcttccagaggagagataaatatatcgcttaagctgatcacctagctgctgttagcataacaccacacctgcgctgcagaccgaggcccaccaacattctcatgtttcaggtgtttgagcagcttcagctctctatacgtgcgtttcgacagcaccggagtgctgaatggtttcatgatcttctttactgcaaccggctggcccgtcaattggtctcgcgccgagcttttccaatgcaccctgtcagtcccagtcctccgcacagaactcgtcgccagctcttcgccgagaaagccagatccaaacgtaccagacaagaccaaaagcacccatgcccaccggttgcaggtctgtgtacctgagtcccagtcaactgacgattctgccacatcatcgacgcagtgcacccgggccacccatacctggtggtgatttcgaaggtggtgccaaagatctgggcacgcacaaactccgccatggtgagaaacaggcgattcgcacgggacacaaaccaagcaggggggttttgcgagggacaggaagctggtcgtctccggtacagcagttaggcgatgctgatgggaagagaagatagatgggtgtggggaaggagtggcgggagccggaagaaggaaaagctggttggcgggtcagggtcggaatggcagagcaagggaagagcagggaatatacgtctcggagggtgcggggatcctggctttgttcccgcagaacggaagagacctttctcgacttcttcgagagatcgggggagctcttatttttttttttcaagaatgacgttgacgagatagcgcagttggcgaggggcccggcaggtgggcagatggcgggtgacggcgtgctgactggcggaatgcttttggcagggcgagacagagagcagaccgcccagggcggggactctgacgctgtcctgcagattggctggaaatgcgctgccgccgacctggcagcgttagcaacttcagaaccggccagatggtagcgggcgtgtcaatccagggtgccaaaagacactgtgcacgaatgaaatcaacccacaccgccagcatggggcttgtgccctggccagcacaccagtgacaccacgtctacaatacagagagcatcgcctcggacagcggtggagcgccccttgggaaactacgctgtgcaatgtccaccggtggaggctctcgatagactagacgccatcgatcgcacgataaccagatccacgattcgtggtgaaacgatgcgcgaggactaaagtagacaagaattatgagatgcaggagacggcgtcgtcaaagctccaagtagctaattattacgtgtagactgtcgagttgtccttgcttagagcttcccatcagggcaagcttcgattcccacagagatatcgctgccacgctccgtcgtggatctcttgaggaattccacagagcagaagcatgttggcactccctacgtgctacgaagaccatcattgggcgatgcacttcacgcctatcgtggccaagtcggccttggccttcaggggctgaggctgaggctggcgcgagggaacagcattgctccggtctccggacacgtacctagccgagtaaggcctgcgcagatcgcgagtctaatcctgatagagcaccaggctgactgcgcacgaaatcctagggtacggactactccggacagcccttgcgcaggtcataatactcgggggatgatggtcgactcagggttcccaggcgcagtggcatcgtttgctctccttcgcttcgctttcgccccccccccccccggtgaggttccaattggcctgccacactccgcaggcaccgtttggttgcttccaggagcatgccgtcatgaatctaggacaatcctccggtcctcgtccggcgttcccgtggagacacggacgcgctggctgtaaaatgtacagagcagaggagaggaggatttcgccagcaggaagcagaaggccggggctgcccttaaataaataaagacgtagtccggccgggatcgcgtgtctgcctcacaggccagccggtggtcttctcgttggggccacctgccagacagacgatcgcagcgatgctgaagaacacatggacgaggccgcccccatctcggcgacgcctgacgacgaaccaccgcagggagacgctcgggccagcgggcggcgggacgcgattggctggcggcgggcctgggtggctccgcatacccgctgcccacgtgaggagtcgctcctctccgcaatggctgaccaagccagcatcgctgcatcggcgcgcgacggactgggttagctgattcctaatcgcctccccgcggccgctctcgcgtctccaggctcagctctcgtaggctgggcagtcccctggagaggcacagtcgtatcgcattattatctcgctgtcgttgaacccgtacacctcgcctggtgcggatcaggcaaaccggccgtcctgaagtttgatctcctccctgtcctgtcctgtcctgcccttttgtcgtcaagcgccaacagcgcccgctccccctcggcaaaccccccacagcccccgatagcacgcctcagccggcgccctggcggcctggaagcactgtccagtgtccacgctgctaaggttatgttgtgctgtgccccaggcagagcctgtccatgtaccacgctgcgtgtaattactactactaccgcctcttcctgcgtccacctctgagccttgccgcttcctccttcgcccaccctcctcttgctgtcctccagctcctgttcctctggcctcagccctcaggtctccctgcttgagcctgcatctacgtcctgcacggcctgaggagtaaggacggcaacatcagcctcccttcagctctccccacgctgccgtcggggaacgcacctggatcgccggcctcaagcttctatctcgccccggtccctcccaacttcggacgctcctaatcgtcgcatcttgtccacaaccgtcgacaagatatcacgcttctctcattctgccgtttctcggacgattgcgattctcccctccgtggcgattcactgccgccatcccgttcaacgtggacgcccagctcgaggtcgctcccgctgtcgtgtcgtcagcgctgcattccgccgccgacgttgcgaccagacacagcccgactgaatcgatctcgttccgaccgccgtcgtcagttcacagtcgactcatctagcttcgagcgccacgatatttgcggccctgtgccctcgtggctggcccccggtgcttccgtttacgcctgtcggggcgctagtcgacttctttgttgacggtttggccgtattgcagctgaacccggactattctcatccatcatctattcttcgaatcgccgatcggaagtttgaacgtgggaaaaattcgtgaatcggaagagtccccaaagattcatccaatatgggtgcgtgtctcagctccgagtccggtgtggacttagaagggaagaagaggagtcagatgatcgataagaaattggaggaagattcaaggcgactacgcagagaatgcaaaatcctacttctgggtatgtgacgaatatgatagcctgtctcggttcattggggctgactttggctaacctgcccaggatccggcgaaagcggcaagtcaacgatcgtcaaacagatgaagattatccaccaaaatgggtactcggtcgaagagctcgccttataccgtctgaccgtatacaagaacctcatggactgcgcgaaggcgctgattggggcctaccaccagtttgacctggagccgtccagccagaaagtgcgggattatatcaccttcctcctggaatacaatatcgatcccgacccaaatacccctctcgaccccaaagtcggggatgccgtgacatacctttggaacgatccatgtacttcgacggtcctggaacatcaaagcgaattctatctgatggattccgcaccatagtaagtggtgtgtgtctgctctgatcagcggatgaaggctaatggcatcgaaacagcttctttgaacatgcgaagcgaatagcagagccggattacattcccaatgaagccgacgtgctccgcgccagaacgaaaacgacgggtatatacgagacgcgcttcacgatgggccaactcagcattcagtgcgtcttcgcatcctctcgagaaacatgacttgttactgacgcaggtcgacagtatgtttgatgtcggagggcaacgaagcgaacgcaagaagtggatccattgcttcgaaaacgtcacgtccattattttctgtgtcgcgttgagtgaatatgatcaggtcttgttggaagagagtaatcaggtatgcctaacctcgaacgtggttggtctccagagtcactgatctttttttttttcacttccaaagaaccgaatgatggagagcctagtgcttttcgactcggtcgtcaattcgcgatggttcatgcgcaccagcattattcttttcctgaataaagtcgatctgttccgccagaaactgagccgctcgccgttgagtaactacttccccgactattccggaggcaatgatgtgaaccgagccgccaagtatctattatggaggtttaaccaggtcaatcgcgcacatcttaatctataccctcagtaagtactcgccccaccaggtggcatctagagcagtcactgatccgccgcacttatagtctcacccaggctaccgatacaacaaacatccgcctggtgtttgccgcggtgaaagagaccatcctacagaatgcccttaaagattccggtattctataacctcagacatctgttcgtggttcgatccagttggcatgcagatttttttttcccccaccccttttcctcctttccgttccagcgcggttcctttctccattttctctaatgctttctgccggtcatcgcccttattctggttacctttcaacgcagccatctaatgacttgactacccaaatattcttgctggtttttctttgcgtggaaattgagacggcgttcatgggggcggcatcatctaacacttttcttattgtttttgggcgctttgatgtggcatatatctgggtatgcagaaatgccgtatgttttgatatgtgatttttctttgcgatcgctgttcattcatatctggcctgtgaggcccaattctttccacccttgtgattcttcccagatttcccttgccgcttgggagtgctttctcgttcatcgctttgggggcaaaagttgctggcacattgagtttctttctcttattgtttttcttttctatttttctcttcgcgcattggatgatgatgaagggcttggaccaggcctaactttttttatcaagaagaatttttcctcgccagtttctttatactttcatattttttttctatccttcttttcttacgtttatctttttcgcgtccttttttttgcatttatgttgatcgacatgtcagcgatggagagagggaggcggccgtcttctcccggcttcgttcatccgtgttttggtttgggtcggttatgccgccttgtacgcataattgagatttttttttctatattagcgtcttgtcttcgtacttggtctccttctcagatgtggccctcacatgggagctgcacttgggcccaaagccgtaaatcgtgcctgccagtgcagcagaatcattccggtgtactatactaagtgctatactactaatttagttacgatatttttctctacagatggggaagtagactttcgtcaagcttcgcatcaggattttgaaacggacagccccggtttctttttttctgatccttcgggtagattcccgtaggattacgcttgatcttcctctgcccactccctatctaccgatggtggttcattcaataggcgacctaaatacctaaaattgtcaattagcacagccatgcccagctgaaactgattagattccaatgccactgaattcgtatttctttattcaatggcagtgctgcggtggcaggctgtgctgagaaacgcgagttgtcaacaattttggcccgggaagatccgcccccaggagccagctggacctgcagcaaactcgaaacagaacaaaaaaaaacgtggcaatgtgagttattttgggcagcctgaggcctgaggctttttggggccattcattcaagactcaagtggatccgtcaataatgccagtcctgcacgaattatcctccccaatgatccaatctatactctgtaggggcaggagggcagctagggctccccaacttcccagccccatcggacggggggatttacgattcccatgcctgtcttgtctatcacgcgattcacacgggtttttttttaaggcgatttaagcccggaatctatttttcttggcgtcattgccggattgagtatcgtgacgtcgtccaagtcgcttgatcggaaggcggcgggaagcatgcttctcctggcttgcactggacaagacaagagtcacggacacactattattagtctattacttcaagatagtaatagtaatagtggagaatccaacaccccaaagtccgttgctgtctcgtatcaagtttggttttttcgtgctcgtgttttttgcacgccatgcataagtgatgaatccttgggcgctagcctaatcttatctgagcaggactaaatgttgatggcggccacgtgttggattgtactgtatagtacatacctaggtacagtacatgtattcaatgcgagcttttgatatatggaatacttgtatgttatatatctacattccatatatcaaacgctcacgtttaaggtggtgaatctacagccgcgcagcgaatgtatgtacagtacagtactatagataggtaaagagtcaccatttgtcccctcagtgttcggcaattgccatgatttgggtggcaggggtgattgcctgtagataacgattgaaatttaattaatccatgcgagagtaggaccagcaggggtcgtctccctggtggcggccggtttcgaccatttctggcccagatctatccatgggtccgatcgaccccgcggtagtaagtaggtagtagtggcgctggatgatgaagagtgcctgcccaacaggtagtcttcgaaataggaaccaacatgtcgaaatgcacaggtaagcctgggattcgtcggagggtataacggaggcacgacatacggtatcgatccttttttgatcacgattcacccccgcagagactgaacgtctagacccctggtcacgctgccccgccttcttagtcatgctgtcaggtgaggtaaacatcgaccaggtacaaggtgctcgcatccatggatgtgcctgtcgactgctctgtccagacaaagacggccggactggcaacgaatcacactgccagcatgatgctacatggctttctcttttcttgtttttctccaagcttcacccctggccgctggacgagctgttggcatcatgggaacccctcatgagccaacccctgttctctcttctttcaccagcagcccttcactgaatgaggcgccgacacacgcctcgcaatttctcatctgacttgaactggacacagtaattggcagccacccctccccgtgttggacggtctttctcaatccgggttcgaggcaagcaatgaatgcttcgaccaacctgttccttggcttaccttaggctcttgaacgcctcatagctgtcaactgaatgagactctgtgcgacgctacatttctctcctgctattgctgtagaagctgtatcgtagcgcctctactattccctcctggttgcgttgatccgcagcattagacattctgtccgattctttgttgttggcgcttgctctcctattcgaagccttcaccaccacgaagaaacagcgacctgcgacatccgtgcacgattcttgactccctgcagcggtgcaacgttactctcggtagatattccgttatatgtggatactgcttctatctaacaaacaccgagagaatcaattatacactgagtcaatctttcagctgcagtcatgtcctccaagcctctgtctcgcgagcgcagaccctccgtcggtgcccccatttccgacctccaagggcccgtgggaccgggtttcagtcgtcccaagcacaagcggaccttcactgggttcggaccggctgagatcaacgcagtcgaggccagtattccggaaccgctgagggaggcgtaagtcggacaagaacggacatttcttctgtgaataatcagttagatttctgaccgttcttacaggtggcagaaacatgtacgaccctcccattccctctaccgctcgtgctatacctcgatcgtcgggatggcagttgagaagccgaggtgacgttaatcttaatcatatgaaatcgtagtccgcgaaaagtttccagaacaaggaagaattcgaggtatgcttacagccaagagccgcacaactatgcgctgtttctgattgtcccctggtctggggtagcatgaattcattcgccatgttgagaccaccctggcgcgctcgctcttcaattgcgatgagtcgtatgtcacgctttcacctgtcttccggcgtaagaattgagacagatactcaatatgacattcaatttagggcggcatatgcaggaactgctctggccttccgagaccggctgattattgaatggaacaagacgcagcagcgtcagacatttgcagaccagaagcgcgtgtattgtacggtgctgggaacatcactgttgtcatgaaagtaaacttcggacactgacattcttgtctattgctcagacctttccctcgaatttctaatgggtcgagcactcgataatgccatgctgaacgttggcttgaaagatgtcgcgcaaggtacatacatacataacttagtctacgcacctgcccattaccataaaggttcagcacgctgataaggcattctagatggcttgtctgagcttggtttccgcgtcgaggacgtgattaatcaggaacatgatgcggcccttgggaatggcgggttgggacgcctcgccgcgtgcttccttgacagtctggcgactctgaattatccagcctggggttatggcctgcgctaccgctatggaatattcaaacaggaaatcatcgatggttaccaggtcgagatccccgattactggctggattttaatccctgggaattcccacgccacgatatcaccgtggacatccaattctacggccatgtcatcagataccaagatgagtatggaaagacagtcaactcctggcagggcggcgaaactgtccaggctgtggcatacgatgttccaatccccggatatggcacaaagacgacgaacaacctccgtttgtggtctagcaaagccaccagtggcgagttcgatttccagaagttcaatgccggtgactatgaaagtgctgttgcggaccagcagcgggcagaaaccatttctgctgtgctgtatccaaatgataatcttgaacggggcaaggagctccgtttgaaacagcagtacttctggtgtgcagcatccttgtacgatattgtgcgcaggttcaagaagactaggcgtgcctggagggaattccctgatcaagttgcgatccagctcaacgatactcacccgacgcttgccatcgtcgagctgcagcgcatcctggtcgacctagaaggtcttgactgggacgaagcctggcacatcgtcacccacaccttcggctacacaaaccacacggtcttgccggaagcgttagagaagtggtcggtgcctttgatgcagaatctgctgcctcggcatctgcaaatcatctatgatatcaatctgttcttcctacagtccgtcgaaaagagattcccagaggatcgagatatgttggcccgcgtctcggtgatcgaagagtcgcatccgaagatggttcgaatggcacatctggcaatcatcggatctcataaggtgaacggagtggcggagctgcattccgacctgatcaagacgacgatcttcaaagactttgttgccatatacgggccagacaagttcaccaatgtcaccaacggcatcactccgagacggtggctccaccaagcgaatccacgattgtcggacctcatcgcttcgaaactgggtggctttgagttcttgaaagatctgactctgctcgatcagctggaatcctttgtcgacgacaaggccttccggagcgagtgggcagagatcaaatatgcgaacaagattcgccttgccaaacttatcaaggataccaccggatacagcgtgaaccccagggccctgtttgatgtgcaagtcaagcgcatccacgagtacaagcggcagcagctcaacatcttcggcgttatccatcgatacctgaagatcaaatcgctgagcccggaagagtgtcagaaattggttccccgggtatcgatttttggaggcaaggcggcgccggggtactggatggcgaagacgatcatccatctgatcaacaacgtcgccgccgtgattaacaaggacgccgatgtgggcgatctgctcaaggtcatctttattgaggattacaacgtcagcaaggcggagatcatctgtcctgcgtcggacatcagtgaacacatctcgactgccggcacggaggccagcgggacgagcaacatgaagtttgttctcaacggaggtctcattatcgggacgtgtgacggtgccaatgtaagtccattcaggaagaagagagttcacgacgaggatggctcctttttttctgactatgtatatgtgtcatagatcgaaatcacccgcgagatcggtgaacagaacatcttcctcttcggtaccctcgccgaggatgttgaagagatccgacaccgccaccgctacgacggcttcaggctagacgagaacctagcccgggtattcgaggagatccagaagggcacattcggcgacgcagacgatttctccgcgctgatctcgtccatcacggaccacggcgactactatctggtgtcggacgacttccactcgtacctcacgacacaggagttggtcgacgaggcgttccaggaccaggacgagtggatcgccaagtccatcacgagcgtggcgcgcatgggcttcttctccacggaccgggtcatcaacgagtatgccgacagtatctggaatgttgagcctctgccggaggagtaatcacatgtatataataaataaatacctttttttttccccttttctttcatatttctcattctgtctagcttatatgtacgtctctttagccagctatacacagtagttgtccttactatacatatctgatactcacaggtcgacaaatatgacaggcagtcttctcttcttacagataggatggataaatgaaccgatcgatatactatagttgtcatgaagagatttcttttctttcctttgtcaaagaaaaaacaaaaacaaaatgttaaagcatgtaactcattaacattgccattgccattgttcatgctcacagcaataggtatcattattacagccactaagataagaaagaagatagttacaacctagaactatgcccttcgtttgtttgtttgcttgctttgtcttttctggacgggcaaggtccgcctgtttttttgtctttggcttttgcctccatggagagtttgatgggtctgggggagtgcatatgccatggaaccaattaacaaccctacatgcatcccgtctcgccttgggaagagagtatcattcgtcatcaacaaaacagcatgagcatgaagatagaaggaaataaaagaaaagcaacagattcatttatcccacccggccaggcttcctcgatgcagggagcaattggaaaatccatcagagttacctcacccgtcaccccatctcaatcgagttagcggaggaagtcgaattttgaaacatcacctaaatgcttcagcatcacaatcatgattgtaaggaaaaaaaaaatgaggcgtaaatggttcatgcaatgtaagccagctcatccccatccaatcgttcaatgtaatccttctccataagggcttcgatgttcttcttaatatccggtatcttaggaggaaaccgtgccttcacctggttgatgacctcctggactagctggacgtgtttcatcttcttgcgggatttcataatacggacaatcgcagactgaaatcaaaagttagtctcgtcaagatatcgaatgaatgcaaaactttcgactgagcatacctgtagaagcagtttccggtcctcctcgatcgtcttgtgggtgtcgtcggattcatgcttctgttccgacttgatctggatgttgaggttgactttgatcttcttattcttgaagttgtggttcagactgaaagacacgcccggcgctggcttggctccttcggggttggctagcagcaccttcgccttgagaagaatgctcatgttcggttcaagaacctcgttcgacaacttggtggccttctgaatctccgagtattccagcgtgtcatgttcgttgtaaagaagcaagattcccatctgaaacgttgacacttggaacgtgtagggaaccttggtgttcttgatgtagttggccttgatttcacccttgcacagctgccacagccatgtcaacttgcgaccactgtgcttatcgaagtaaaagctctggaaccgttcggctgtcctgacaatctcgggcgggggaatgaattccgtcgagggcgggttgagaggccagaatcctgttcccaggatctggaaatgcggatccaccatcttcttccggtcttcctcatccaagactttatcctgccagtcccgataagcggcgttgagatccttggagatctggatgtcctggaacatgcgctgcagcttgttcgtgtattcaaacccacacgcctctttcagcttactgatcatgctggtctctgcatcgtccgagacggaactaacgtgcaccaggcgcttcgcaagcatcttggagtagaacttctggaacacatccttatcctcaatgtacttgaagaccgtcatgatctggcctagcatctcctccaattccgattcctccgcggccttaccgcctttcttgagtaatgagtcggtgtatcgtgccaacagctcgggcgacttcgtggaactcgtcttgcagatctggttgcggttgacgaactcgcggcaggcgttgtccaaagaccggacaaactctgattctcctgcaaatgccacgttcaccaggttctggtatcgcgagtggacctgcagcagcgcatccacgtacgtcttgggctcaaactggtctccttccgccgccaccttttcgacggcagccaacccggcctttcggacatgggtctcaaatttcgcccggagcggatccaatccatccttgatcttcgacaggaggcggtacatccgagccagatcgtcctgtcgttcgttgtccaagaggacctggaattcgtcacgcaggagaccagaatgcgcggtgacgagaacatccaaacacgtctcggtaagacgcttggtgatgtcaggatgcaggtacagtcccactcgggccttctcttcctccagacgagactcggccttcttcatgtattccacaacactgttctccgcgacaaactgtcgggactcgttttcgtagtagacccgggtggcctcgatgaagggccgctcgaaatagtaccggtacacctccaaagtcgacttagtgctgtcgttctcatccagacccaatgacacgtacgaatcgacgatgtttttgatctgcgactgctcgatcgtctcgccgttccgttgtttctccaccagattcagcactgcggccatgaccttctcctgaaccttcttgaagaagtcctcccgccacttaaccagatgaagcgtgtagacatcgtagatatttttcttcccttcatcgatctccctcttcacccagtgtcgattgaggtatcggaaaaggtgattgatgtattttgcggcggttgtgtatcgatcccactcccggatatagaatcctaagagtgcctcctcagcgtgggtttcggaagctttgtagacattttcaagatggcgtgacaagtattgaccgagaaggttgtagagttcttcgccgaggagatgcgctatcaacacgaggaagctgtcagcggctgatcacacgttccaagtaagaagagaagacgaagcacataccgcctcggtgagcttgcaagcctccattgctcacagccttttgagacgtgcagaagttgtgtaccgccctacacaatgtcagctggattcgcagaccggaggtacgggagacacgaacgtgtagagagccatgtactatatagtagtaaaactggttgtcagtaccgcccaaaacgtgacaagaccagatcagagaacacgtacggtcttcatatcaacaccctcctccagcttgagcatcacactgtcgatgcccctctccaagaatgtccatctgcaattattaaccactggtcagcttcgagcatcatgccgaaagcaagatcccaactcctaacacatttgtgaacgccattccacggaaacttacgtttcgtcgaggtcatccttgtgaggggttaccggcatcgcagtaggcatggtcgacttccggagacgattcgaccggcggagaagaccagcgggagctgatgagacttcggaggtcagatccttattcttcatggtgtgtgcagcgatgtgggggttcgagaaaggaaaagagtgtgtttcaagaagcccaggccaagtcgacagaagcaagaagtcaaaaacagacagctggagtgcagatacgacagggactcggatggatagaaaaggccacaggtaaacaagcactgggagagttttgatcaagcgggccggcggagacgcatgcacacgtacgtgccgcgagttacctgacaaacagcagaagcttgccaacgtgatcagattgtgacggtttgggttgcagggaagggaaccatggcgaccatggtgaaggttgccaaccgccgagatatgacaggcacaccgcaccagggccggaacgttccaccagacgcgataaaatcaaaggagggcagggcagccatgggatgggatggatatgggggtaatgcagtggttattctcatactcactagatcacagatcagctcagacaccggagtgtctgctggagacgctcgttcaagacgaaacgagaagagagcaggacgtagctgcagcggggagggttgggaggatggcaggggagaaaggagcgcggaagagggaagagataaaatgtagactaaggatggcggtgacagtaacgagcagtcggtaggagggaggttcagatagtaatgcaagttaagctaggcatgcacgcagcgcgggagtagcgatgggggagcgggcggcggaatgagttctggggctctggacggagaggcggttgttgcctttgccaatccacggcttgcccgcttgagttaggcagatctctcgcgccgcccgttggcggtctggcggcagtgacgtgacaggtgactgtgccaccaccgccctgtggctgcctggcagtttttgcctgaagaataatcgtcacacagaataaaaaataatttccgaggactctccagagatactacagttttagagggcgttgagtcttctaaagtgctggcgatcgctgaacggaaccttatcagaactcaacactacctgcaagtggacagataattacagtacattacatagacagacccaacagaagtaaacgctcccaagtgggattcaatttgatatgcgtatgccatggctatctctatagataaaaaaataatactgtggataggggccataagaccagagttatcttaaattacacccctgtacgcgtaactcagaggctgttgcaggttgtgtgtgcttgctcagagacgcaccagatgacgtcattccttggttgtttgtactgaacgtctgatagtctccaggaacgtgtaagtatcgcttctctgctctccatcttggaaataaacagtgaaatccatataatctcctatcctgtggatcttccagggccaggacgctaaacaacgactcagctgacaaaccatgtgacctagatacagggaagtgccgtgcggcagagaggtacctgacagactcgagatagacgtccacaacagaaaagaaaagagacatcccgcatcgaaaagagccaacaacgaagacaaaaaaaagaaagaaagacagaaagaaggaagaaccaaagatgtccttccgcccagcctccgaaatccaaattagtcgacatttgatccccgcctggcgtcgcctccccaacacatccatccaaaacaagcccctgctgatctaccactccgcctttaacgcttccgctgctcagctctccgcccgcctcgatgaagtcggcgttgttgttccccagtggcagtacaccatgtatcgccagacacacttccactcgaccacccacgagatcctgggcgtcatctccggccgcgcgcgtctctgcttcgggggggaagagaatcccggccgggtcgagactattgtcgagcaaggcgatctgatgattcttcccgcaggggttgcccaccgcctgttggaggatttgagtggtggccggttcaagatgttggggtcgtatccacgagggaagagctgggacatgtgctacggggccgataacgagaacgaagaagaactgaggaagaacatcgagatgcagggatggtttgaccaagatccactgtatggaaaggatggccctgccgtgcacgtctgattcgatggcacgaaatgttacatccattaataagtacagtatcataatttagtcattattgcagatcatgtgcgcatccagttactgtgcatggatgactgctagaggccaattacccataatcaccctatccaaaactgcagtataaacaagagacaaaaaaaagcattatacagtacaatagaaaggacgtatggttgcaaagcagcactccagaggtcaaccctgtgacctccacattccgtccatatgaccaaccgtttagacgccattcgtaaccgtcagtaccaagcaaaaaaaggtaagcaataaaagaagccgggagggtgtctcatttcgaagccactctctccaccagtctgaacatcgagaacaagagatggtcagcatattctttcaatccgagaggagcggagacggcttaccggaatacactgatcgtgaaggttaagagccatgcgatcaacgcaatgagcaggaccgacgcaagcgccgtctgccaatcacagatcgtgtcgttctttgcgtcaaggtgatggttgatgacggaattggtacacgaaccctggacatcggacagggacgcgaaggcgagactcaggttggcagaatcgaagacaatgaagaagatatccaacagtatcagtcgcattttggccttgggagaccggagccccaagggcttccccgtgtattcatcataggtgatgtacaccaaatagaccagggctacagcatcgacaatgattgccatgtcagcagaaggaccttgagggcgactgtatatctgcgaaagatgatggatcgagccccccagcgccagcgcacacaaggagaagatccacaccgtaagccggaacacgagcggaacgataggactcttcaacaagttagactgcaaacgcccaatccaagttcgacgccttgcacgccatctagtttcccggacgccctgttcggcgtcagagccgtcatttgtcgagttccaaggattcgaatagtcccctaggttctcgttcagccaatcccaggtcaccggcttctcctccagggagcttgtagtgcgaggatacgcgacagatctggcaaatcttatccagcgggacacccggaatcccgtcgcggggtcaatctgatcctcgtgctcttgtccagcttggtccaaagacggtttctgctttgcgtagggcgagtgattatgctgggccacgacggcatcgtcaagctcggagggtaggagcctggtggtcgcatcgctctcatcctcaggtatctctacagatcgaatccatgctacaataaagcgatttggagttagcatctatactagctagatatctaagacacttgtgcgcctgacgtctacttacctggcaaggtccgaacggccggtgtcgacggccggtcatgcgccgagttctccgcagacgccaaaggctgtgaggactgtgaatgactggttgaagatgtcacagtccctcggcgaggctcctgcgatcgagattcaccttcaagggtggtgtctgacgaagagtggccggcggggtctgttgtcggttgagatgctggatcttgcgcatcttgggccattgcctgctgttaataagaaatcgtgtcctctagatgatatgtgccatgatatacggccacccaatgaaggtgttgatattgacgctgtccacgaaagctcgagacccctgcggagagggcggcgcagtgcttggcgggacgtcgtcaccatgttaacgatactccggagtaggcaggatttaaagttaaccgattaaccaagcctggaacacggcgatccccgtaataagaatcgagcctcttctggcggcgctgctgcttttccggattccggcctgcagctttggccagtcgaatgacgtctatcgcacatgtgtcatcgtttcggcctcagacgctttccctagcaccaaggctcactctcatgctggcaagctggcctttgcaccgatcttcactcccgtgaatgagcctgcagaaagcatgtcacctattacagcctccttttccgtcgcgttttctgtgagatagggaagccttcctcattgaccctccttcccccagccttcgcccacggccgttgctatgcgtctattcctcgtccccatttcaacgagacgcgctttcgtatactgccgatcccccaacgtcttgaacgcgtcgctcctggacaaggttacggccaaggcagctgaaacctgggagaaatgggagcgagccgataaagggtggaggaaaaccctcgtgtcctatggccatgttgttctccagcggattccctatgaagagtggggtttgaagagtatccctcctctgagcgcacagcgccagatcgaggaaactcgcgagagaaaaccggttgatgtggtgtttccgagaaatgcaatcaagccggaaaatgtgctgggtattctgagcaagctaggcacggagagacaggatcatcatcgcagaaagctgtggtggagcatcgggcttgcccctctgaccttgcccattgcagtgataccattgtaaggtgtcccaaagttcacattgctagggcgcagcaggggagacttgatctaattgtttcattgcaccagggtgcccaatatccctttcttctatttagcctaccgaggttggtcgcactggcgaggtgagtgttgtgccctgtagatcaattatgtcatttcatgggactcaccaatgtgcagctctaagcggctcaaggcacctggtttatttacatgagaaggggcttttgcaccctcaatcctctccagagctcgagaatttctattctaaacgtctcatctctggtagacaagagcatgggaatgaaaagtcggtcgtgcctttaggggaagaggatacagaggagaggctgctcctcgaagagtcagatgggaaggaattgggcgagatattgggggctccagagatcgcaattgaagtggaacgcgctgttgttcaaatacggcagaagctgcattctgagcaagatgcatctgtccaaggaaaaggaacgcgcgggtctaatacttcgaaagagaaggagttatgaagaggatttgactcatgttaatcctcccattaatgggccttaccacttcagtcatttgactcattcctacagtgatacccaaaactccttttgaatttcttcccatgcaaatgggaaaatgcatacgcggttgagggctggttccattttgttcgttgattgaaagaaacttgacagcttttcatgctgtttctgtataatagtcacatagagctcatctcattacacataaaaatatctctttacgcatccaagcatagtatagtattgacttgtgttctaggtagatccgatcacacttgctaactcgtactcgaagatctgcagcaactagtttgttcattttctttgtcattgcgggcaattaggatccttccttccagataccctgctaggaaaatgcgtaatttctaaaaatggaaataaaacaaaagctcactaggactctgagagcgcaatataaaaaaagctcacaccaggggtcctccctcccgggacccgcaggtgctacgaaaacccccgcctatgcttttggcgggcagggattttactaccactttttttttggtggaaatttgggtcagagaccagagggatgattcgaacccaggccgttcatctggactgttagtaggtgtaagagacttaggctacttaaccactgcaccatcgcagccctggtttgttgacaggccagataccctgctaggaaaaatgcgtaatttctaaaaatggaaataaaacaaaaagctcactaggactctgagagcgcaatataaaaaaagactcacaccaggggtcctccctcccgggacccgcaggtgctacgaaaacccccgcctatgcttttggcgggcagggattttactaccactttttttttggtggaaatttgggtcagagaccagagggatgattcgaacccaggccgttcatctggactgttagtaggtgtaagagacttaggctacttaaccactgcaccatcgcagccctggtttgttgacagggtaaacaaattgcgggtgatatctgcccagagagctaggtttcaagggagaatagactgctggtctctagagctaggtccctaggaggcgtttctaatgtaatatgccttagcctgcttcgaacaccttgtctccacatgccctgccttcgaagagcctgcgaggcaaccagactggcagagggcgctctactttcttccttgcttttcagtcacagttacaacttcactactatctatcaccgcctacaatgctacctacttcagcttatcccgtcaggtagcttcatagaatcgagcaatcgtcaggtccaacaactcgagggtagttgtcatggcattcctttctgattgagcggaatttctcacatcacatcaccatagacttggagtctccttagtacgatcacctcagtcgcttttctgcttttctatattattatcacgtgtgattttgtcacttcactctgtttctatatttgcgtcttttattagccttcatcagacctacttagctgcttaggtgggtagatactccaggtaccaggtaagctatcattcacttatctaagctatcttctttgagcatatcttaatccgtagtttctattttcctaatagctgtcataacgccagagtccatcagagaatgtcgactcacgttccaaggctccacaaccccacagactccacagcccgcatggctgaagaataaacaatcgcccggggttcttaacttgatctctgatcaatctctgatcaacgaagtacagatctgtacaactgaatccagaatagaattcatagccaaaattgaaatgatagtctgccaaatgcccacaacgaagcctacaggtagactgaataagggaggaaaaaaattccacccatacgacacccatccatggccctcggaaagtgacaacactaaggaccagagagtgttatggaccatccgcagaatgcgttactgttgcaggaatatacagagttgtatgctccgactatgtctggacaagctttgcctataaatggtcgtataaaccaagtctcttgttaatatttcttgttaatatttagaatattgctaatcgatatagacaaagatatactgccagcactttgaaaagccaagtcctcccctactaatggcctctgctcaacctccatactagccaaaacgccaaactactggtaggttatctgtctgaggatactaataatagcgccaatacgggtaaggaacaattcttctggcatctgagggcaagaatggttttgacacgttaaagaagactgttctgtgcgatagatgctgtcgtctctgaatatattcaattacacagcaactaaagcaatccttcacaatacatcgatcgactcagcctatgcctggtgggccaatggccaagggctgaacatcgtgataaatattcgttacacgcaataatttatctttactcaagcagacatagcatcaatgacaattgcgtgccctgtgctggcttcgaagggcgataatcgcaacggaaataggttgatccgacgggggcgctgggacggcgatgctggcgccgggaagctgtggagatgctccaatacgggaaagcaagcaagcggcctgcctgacccggacaacaacagcgaccacccattgaaccacttctccgccgcttctcatttctgctgctgtcgtttctctttcggttctcggtctgtgggagtggcagtggcaggcaccatgtcgaacaagagaatcgagcagtgggaaatcgagcggtattgggagatcttctcgtcactcaccaatggccagccccgtctgaacaactcgcaggctgccagcgtcctccggaatagccggcttcgtgatgagcagctcgagaaggtttgggatctgtcggacctcgatggagatggggagctggattttgaggagttttgtgtcgctatgcgactgatctttgatcttgtcaatggggtaaagtggcacccatatgtcgagctcatgccggacatcacaagagccagggaaccttggctaatattgtgggtgtgtgtggaaataggaatatcaagaagtcccgcgcgcattgccagactggttgattcccgaatccaaagcgcatttagttcaggccgcccaggcattaagcggtcgccaggaacaatttgagaggatagaagacgaagatgagtcgcaggggttgaaggatgggtttgactggtatatgagcccgtctgacaaagcaaaatatgaagaaatctacgatgccaacagaaatcatcgtggagagataacatgttcgtgactcccgtgctttatcgtgccccgccctttgcaccgtacatgcgtggatgctgatacatctttttctgcacagtcgaatccttacaacccctttatgattcactggacgtaccagacaccgatatacgatcggcgtggaacctcgtcaacccttccgcgtcaccttccatcaacaaagatgccacgctcgccttccttcatattctgaattatcggcacgagggttatcgcatcccgcgcactgttccgccatctctgcgcgcctcttttgagtccaacaagattgactaccagattgataatgtccgtcctgcgcagcggtggggagtagacggggataccgagacccccactggccgcaaggccaagttcggcgatacgtatctgagtcggttgggtgtcaagtccagttaccgtccccaaggtaccgacttcagcaacacgatccaggatgaggagtgggaaaaggtccgactccgacgggagctatcggagctcgaggccaagctggaagccgccaaccgcgccgcggagcagaggcgagaccgggaacgcccgcggaacgacggccgaccaaactgggcattgataaaaaaggaggcgctgcagcttttggaatacaaggaacgcgtgctccgcgaactacgagaaggcaccggccgcgccaaggaaggacaagacctggagagacttcgcgaggatgttaaggcggtcggtgagcaggttgaagggctgaagaaccacctcgcgaaacggaatgaggttttggaggatctgcggcggcagatcgaagatgagaaggcccggcgatagaaatatacgttaggggcaatgtacatattatactatttcggttcttctgtgaccgatttatgatttttttttcttatcgtctgtacagccatcttctatggaagggagtatgggcgcaattttgcatagggatagtattgtcattattgtgattcaaatctgtctcttgtctacccggacatggttctctcttcctcgcattattattaatcgcacagaaacgaaaaaaaaagtgaagtaattattgtacaggacgtaaaggcagagagagagagaaaaagaaatccagaataccagatacaagtaccctgtaattgcccaaacgccgccctagtcccgaccatccatagacctacgccctaaaaactcccaccagttcaaaatcgagtcgcaaaaaaagaaaggcacgacaatgagaaactcaactcccaatagatgcttgctcgtagcaacgttatcaatcgtcaaatatcactcatcgcacggtaagttcggccataatacccccttggtctaaccccttcgtctcgacggccgtaaaggcgcgtccggtcttctccagacctttctcggctcgtgcgtacgcctcttcgctcctatcggtgaggatgtcgaggtcttcctgcgacagaagggactcgggattgttgccctcgacgtcgaactgctcgaattcgtcctctccgagcgccttgaggagctcctcgatgtcgttctgcgtggtgccggggtcgaggaggctcctgaatttgcctttctggatgacgaggcgctcgagccggcgtttcgagtcggccttttcgaggagtgtctgctccacggtgcctttggtcgcgagacggtagacgatcacgggtttcgtctggccgattcggtgtgcgcgatcctgggcctggaggtcctgttgtgggttccagtcggaatcgtacaggatgacggtgtcggcagccgtgagattgatcccctgaccacccgctcgcgtgctcagcaggaagatcttgtagttatcgtcggtgttgaaggctttgatttgagcttggcgatcagcctggctcacagcgccgtcaatgcgacaacacttccaggaccgcagttgagtggcccagtcttggaggagatcgagctgtgtcttgaactgagaaaagataagaatcttgtgccctttcgacatgagacaaggaaccagtcgatcgagaagaagcattttcccggatgccgtaaccaacgtctcatccaccgtagacgagtcgtcaccccagggccaatagaaattgtgaggagaattgcaggccaagcgggcctgcataacggggttctgaagctttttgttggcaatttccttctctgatgaaaatgttagtgtcaagccacaggtaaagacaatgaactaaattgaaacaagagaaagcaaatttcgggcaaggaccgaacatactggctagcttaattgtcttggccctctcaatctcttcctgttcagtttcgcccagctctggctcttctggttcttcctcttcgataccattctccattctgcgcagcttggcattgaactcacggtcactgatatccttgtaatttggacggcctccccgcctacggcctgagcttgcaagactggccggcgtagaagagcgactcgatttcaagcttttgctaggagacgtagattcgctgtcttccgactttctcttcaagctcgccgcgcgcgacggtctttcactggcatttctagcttcgatcctttccacggccttatcttccaagaactgacgggcggtgccgttgagaatctcgcgatacagttccttctgttcagatttgcctgaggtctctcagcagaactccttgctccagacgctctagacgcttcagacgccttctttgcctcattttcttatcttccttgcagcggccatcggagtataattgccagcgggatcctggttcggggctggggatgggatgcgaggaatgtgcttcttgcgaaggtcgtagggtatggcggcaggagcgcgattcgcagacatctcgatatcggtttgaatataggctataatttcctaattagaaagtcagaaaaacctcagatatgacaaattcagtaaaaaatcgatgggatttggtgagaaaaatcagtattttggtggtttggagggcttccgatacaaaagttgcaattttttgaggttttggggtgccaaaactgcaccaaattttgcatacgctaaatgtatgtacatctagatatgtattacctgcatctttaggattggattaggtagggctgaagggtcctcctgaccagctggggtaatcgaatcaaattccattgttaacatcacgtagggaaattcttgtatcagtgcagtgcagatagatgtgcatacgtgttcgtgtcgatcatattcccttccattcccttgctcagcccagctctgctggggaggggaagggtttttaaaactctccctgggctttactcatcgccttagagggtaactcgttcatatccattctaggaagtttactccgcttggcgagcaaaaggaaataagcagggtggctgagttagactcatgttaattactggcaattattcccgaataaaatcggcccctgcttgccaaaaaagtatgaaagatgcaaaatacgtaatagcatacttctgatcttgcgggttgtcattgcaaggattttcgtctggacaagatggagtcaggctctagaagtaaacgaagccgtccagtgacgagcaagaccttggaccggacaagggactgtcatcaaacagctgagtcttgaagtttactctgcatctgcaggcctctctccaagttccaccgcatcgggaacgtccagtcgaccgacgggcccactcgtagggctgaatctcgtgtcaaccccaggcgcgggaccaagagatggcgggatggcagtcgacaagggaattcaggggaaagagagggatggatagggatgcatggtcttgacctgacctgtaaacaagtctcctctcctgttcccatgcagtagtgacatgggcaaggcaagattgaaccctctgtctgggacataccagctgaaatggccccgggccatgcataagcgttgcaacagaggatgcgacaggaatgttggagagaccatgggaagtgtgattctgtaattgcattggctggaactaactcttacggccaaagtttgagaattgactgttcttccggtcgacagtacataagcatttagatcaaagggccatttcccaaacttaccaatcatcgcctgtatcagggatgacattcaaatgcattctaattcagactagcaggaaaaagcaattcgattaattgtagtggtactacatgtaataggaatgacacttgcaacagggcgcacccatccacacatacctccctgtcgacctatcagcataattaccatggctgcgaaatgtaaacactgacatagaagaagccagcaagcaccttttcgaaagtttattacgcaagtttattaattgtgagcgacagaagatcgatcaatcagattcgtcttctctaacaaccccctttttgccgaccttccctcgttcctgtgtcccttttcttttctgattactggttttcaaactaactatggaggagggtatttaagtaaatatgtacagaacatgtatttaatgttcggaatcaagaataatacacaggggccgaatctctatcacatgaaagtaactgtacggaatattactgacacacacaaacatgatgtaccagctagcttttacccttctacctatggtaggatatcgtgcctaattatgaacctggagcatccagcttctgtcctcgctgacagatggtcgatatctgtctgggagaaagtatcaggtcagttctggggcagccgtgggcagtaatgagtatattcagaaagaaataatggccaattaagtaatcagtatgttaggaatttgcaagatgggcttgagaatggcctttcttgcttctcctgctgggatcattgttgcaacattgtttttgttatcgtcacaatatatcacttgaattgacattgtgattcaccttgtcctctttctccccctttatttttctatagtattttttcttcctttgctaggctattaaattgtaagataggcagagctggaatcacctccatgggtttagataatccgtatatgtcttgttgtgactcgttgcgatgtcgaaatatatccatagataggcaggattgcggacagaaaaagataggatagttgtacgtttagtcaattcagtcaactcggtatataatgttaatttatcatttcttcagattttattctcttctcctccttcttttatttttatatttattttctaaagaaatccctttactggagttgacaatggcaagacgagtggaaggcggtgagacaggcggtgagagagtccgccggagctttgttgtcgctgaccgtccaagtggagagcttcaagcagtccccgcatacctcgactctcttgttcgactcattcacgatactcatacgagttctggtcttacttttacgccccttatgaactgattctctgtatcctatcattcctaccgagcagcggacagagttcgaggaagggatcccatctcccactcagtggaccagaccaggcagaacgcgaagcgtagagtttaggaccggcatatcagggagagtgagggtgctcgctgaggaggcgtgataaccggcgaagcgagtcgggatgaatccttcatctttacccgacgcctcggaggtgactgagctggagggtgaatttcccagtaccgaacatggcggtgggagacggcctatcaaggtcgatggtaatatgctcgggactatgctttctgctacgctggctttagattgaaactgactacttgcgtgcttagatccgccaaagttcgacttggattcctacattgcaaactatagcggtatgatctttctatcccttttccaccacgacgagtttgtcagctcgcgttgtgtgagccccgctgatgatttcagggcgcacgagattcgatcgcctctacctgatcggtacttgctcgacatatctcgctaccgacgcactcaaggccgcggttgtggaagccaaatccggcaaggatgtcggcagataccaaaaggccgtcaaggcattggccgaggtcgcaccagacgagcccgaagcagtcctagataacgactgggtggaacgcacgcagaagcttgtccgagccgagacagatcggttggagcatgaactgagaggttacaagaacaacctgatcaaagagagcataagggtgtgtctatgtctgcccttcgccgtgtcgtcgcatcgtctgactggtttctagatggggaatgaagatcttggatcgcactatcatcagatcggtgacttggcggcggccgccaaggcgtatgcccgcatgagggattactgtacgacgccaagtcatatcgcttcgatgcaactgaagaatatccacgtcgccgtggaccgcggagactggctaggcgtgcagtcgaatgtgcatcgactgcgcacgctgcaaaccaagcccgaagagcaagccaaaaaccagccaaagatgtgtgcagccatggggttggctcagatgtcgcttggcgcctatctcgacgcggcgaacagttttctggccaccgatcccagcctcggggacagctacaacgaggtgatcacttcgaacgacgtggctgtgtacggtggactgtgtgcgctggcgtcgatggaccggaatgagctgcagcgtcgggtcctggacaacagccagttccgcaacttcctggagctggagccgcacatccggcgtgcgatttctttcttctgcaattccaagttccggccgtgcctggagattctggaagcgtaccggacggactatctgcttgatctgcatctgcaacggcacgtttcgacgctgtatgatcgcatccgcaccaagtctatccaacagtaccttgtgcccttcagccgggtgacgttagacgccatggccaagacgttcgcgccgtctaccgcgggtgggaatgcgaacccagcagacctgaactcgccgtttgtgcaggagctgatccgactgatcgaggacggcaccctagatgcgcggattgacctggagaagggggtgatggtgtcgaagcagacggatctgcggatggacgtgcaccaggccgcgctcgaaagcattgaggagtatgtgcgggaagcgcatctgcggctgctgcgtgcgaatatcctgcacgcagggctggaggtgcggcctctggcggcgcaggctggtgagaaggcgagggagcagcgattccacgggcagctggctgggcttgatcgggagtgatcaatcagtcggttttttttgtttccccagatagcatgataacatcggacgtaatgaattgatgacttgctgaagtaacgtagtataatgcaataaataaataccattgtacagttgaatgtattccaaactgcaccaacccttagtattggaagtaatagaagatattctggcctcgaagcttcttctttctacttgcgtatgagggaagtaggcttcttcgagatatgctagtcgagttgatatgataccatgggcaacatcaaaggaataatccttcaaaatgctcatgaccagtagcattgagctatgatcttctcaaaggactatatataaatcgataatggagctatacatgcatgcatgcaataaatagaaataaataggctggtgtgactgaacagttaaaaacaataaaaaaaaagataaagagccacaagtggtgacaatagctagctataacctatcctttcctttttttttgccttccttcacagctttgcctttgccttcgattccgtcatgtcatctttgctcttgttgtcgttgttactactatctatcagctcattcgccttcaacggccccggatggatcttgatatcgtcaaagggcaggttgaggaaggtccagatgtagtggaatctgtttggaaacaaacactgacggtcagaatgatcatacatattattatatctatactggataatggcaacaaaccgatcactcccaaaaaacatcgacgtctcctcctccttcccatcgggtccttcacgaacgacccagaaccatggcgcaccgaacgcgccccgatccagcgcctccttcgtgcgcgccagaagggcgtctttccacttctgctcgcctgtcgcggcgatgatggtctctgcttcgtgggccgtgaaacccgcgtcttcggtcagcaggcgcgttagcaccgctggctgggagatgtcctcgtggcggtagaagagccattgccagaggaggaggaaggtttcttcgaattttgaggccggatagtgtgcttttatgtaggtgattgctcgttggggctgcgatcatggatggacgaaggtgttagtagagaacattattgtattataccattcaggactatatcccttttgtgattcttcttttcgttttaagatgaactcaccaacaacgaaagaatagggaaaaatgacggcgccgtaaactccggtaggccaaagtatcgaaccgcgttcttgcggtcgtattcgctgtagcgggctttggcggggagtttccacgggggtgtgtttcctagctagcagtaaggagctgaaatatcgatagaattattgatagatggttggttgaggtctttgtgtatatgtataggagtgacgtacctgagccgacgttgatgccgccgaggaagacggggtggattctgtcggtgttagtatcgatcaattgcaggtagaatgagcttatcaatttaagactgatatactgatagaaaaaagagttggattgagtaggacatactcgatcttgacgccatgggtcgccagcacagcccggtgcttgcgcaggtgcaggaatgcaaagtatgaatagggagacactggaatcacattgctattagctggtaattctcaacacaatatatgaatgtctataataaaactcttgcttctgaaatgatggcaatgacatcaactcaccgcagtcgaaatacgcgtggatcgttccccccatggcgactataatatcatcgatatgtcagcgagatcacgacagataggcttctcgaattcctgattattattcaatttaaaataaacaaatatatgacgattgtgaaataatagcagttatctttcatcagcatctgctcaaccgaggttcaactggagcgaacctaggcttggcagtgaatttcggatcactcatcactaattcattcatccacatccacttcttccatcgccatcgcaatggcaaccgacaacaggcgtgtttcttattcctgatcatgtcactgtgttaattactcggcctcggactggtttcggttattgccattgctctgcgttgcggagcttggctgtggatggttttaagcgcgcttttatgtaaaatatgtatggaagctagcttgctgtccgagtcctgcttcagtgtgaattcttgacttctatccgctcttgccaatttactgtagattttgtctgacttttctctctctttttttacttgcaatggcgaaacctgtcgccctcgtcatcggagcatcgcgaggcatcggccggcaggtggccatcgacctggccaagaatggctatgctggtatttcctcacttcaataaattcatgagatggggtgcaatgctaacgacgacagtcgtcgtcgccgcaaagtccacgtcggacgccagcaaaaccgtccccttcccgcccgaccccaactcgccgcaatcgaccatcaacacggtcgagcgcgagatccgcgaggccggaggcgaggctaccgccatccctgtcgacacgcgctatgtcgaccagatcaaccggcttgttgacgagacggtccgcatctacggcaagctcgatgtcctcatctacaactcgggcgccatctggtgggcctcggtcgagaacacgcccgtcaagcggttccagctgatgcagaagatcaacccggagggcctgtatgccgctgtccaggctgccttgccgcactttggccggaacggctggaagggccgcatcatcgttgtgtctccgccaatttattcccggtttttccgtgggaagacggcgtatgcgatgggtagttgagatctagactgtatttgttcgtttgaagcattctgactgacattctgccacaggaaaggtggcgatgagcgtcctgacaaagggcctggccatggactttgtccgccagaaccgcaaagacatggccatcaccagcatctggccagcagccgtaagtctttctttggcagcaggttcggctaaggacactcactaaatgcagtcatgattgaaatatctagtcaatcgaatccgcggcaacagagcaaaccaccgcagcggatccttccacgaaaaaggacctccgcaaaccggtatggaggacccctgcagcgctgttcctttctttatgtctgttcccgctgactcttcccgcagaccatcttctccgacgccatcctggccatgctccgtgccccggcagagtctgtcaatggtctcctggacctggacgaggactttctccgtaaccgctgcggcgtgacggatttttcgaaatactccgtcgtgcccggcgccacaccccggcggatcatgccggccaagtttcccgtgttagaggttgccgaacaggatgatgaagggcagaggctggatagcacccagcttcggaagtcgaagatctagcttagcttgctgctcataaatggaccaacaaatgtgaatctaactttgcggatatgcatgtatgcgtcttttctggactttggttcccccgtactttcatctcctgaaaggcataggaaaagggtcgcagagaaagatacatgggtatgtttacaacttcccagcaggaaaattccgaaaagaaaactgtcgataactgtcgtcgtacgacgtcaaggaagaccggctaagtccttgccttcctatctttctcccttttttgtccatctttattccacttcccgtttctatatttgacttcttcactaccgaagtacggataacgccggccttggctacaaacaagtcgtctgagccgatgaagtattcgctaggcacctcccttctgggtgttcactcttcatttcattgcttggttcctgcaggttctatcactgtttgtgaatcattcactcgctcgcttaatctcgcttatttctctcccacacccctctgctccctcaggctataaagaagacgccatctccgtcttctacgagccttcttctcctccttctctttcttcttttaactacggaccatggcttcttgccatggtcctatatatataatatggtgaagcatttctatacactttgcaatatttctttatccttatattccctatatactccaggacggtaagtacctcgtgtcgataactagggccatctggtcctcgctctctttcatccttcttcgctcttctctttcctgcacatgaccgacaccctgctttactccaggaaagcgaacaacagtatatcaacgctttccgtggagccgttaaaaatgcgtgccgtcaatagcactgggagtgcaacttctgtctagcataggcagctggttgaccctcctggaattcgtttgagctgtgagaactcctgtgtaagtatcatcatgacctctgtcgagctatgcgatgctgactgtaagtagctgccacatcgctgtcaatggagaacaaatgtgtggcatggtctttacgaatcagacgtcgtaagttctgcctgtcctgaaagcatgctcgaaggtttactaacgtccaccgcaacagtcgggaatcagaatcatcttcaagactagcaattgctgctcgaggatggttagaaacaaaggctcgacagtccgaatagtcgtcactttgaacattgttgggacgagggcaaggaccaattgcgcaggtaccttgcttcagaaacaccattcaattctgggaaatttgtcctcgactatactatattgctagtccttccaaaatgcgaaaagggggaaatacggctctgtggaatttagatatccaccaagcagtgacacccctgagaagacaatccagtggtgtgcatttggaatggcatttatccaaaatgccattacgagaggcctcaccgttaacgctatatatagatcccggaagagactcaggagcgaggtcgaattgcgagagacagtcataaagcattattagtggcgcaaatgaactcaacattgccggagatcttggttcctcaatggaaacccagccggatgccaatccaggcttcgttgttgatgaagacatttgcaagagagcccacaaaaaagacagttactggactcgatgggactttgatcttgaattgatactctgcccacctctgcccactgcgttatcgaatagcttggctggcagctttgctgcgaaaattccgaagctggtatgttgaggatttatacaatgtctgcaggcagatgcttataacgcgtgcagttgcgaacccatcacgccagaatttcctgcttttcctccttattgcaaaagctgtcaatcaacatgactcatggtttgacaacgagctgtatcagcgtgaaaacgagaccgaggcctgtcaatacctcggaatcgacaaccccgacaggcagaaagtacgatgcatgcatcattgtcgcctgcacttttggcagcctgttgctattcatgcgatgtgccagtttgccaatgacctccttctctctgggtgcctcctggcggacggtgtcggtcttgggaaaacatggacaaccattgcatttctcttaactgtactctatgttcaagctcagcgaatcctggacctcacgaatctacgcgaaaccattcctccaacaatggcaggatcctgattttcttttttaactttcgcgtccaagggtctggactaacaagcaccaaacggtacatacatacttccttcctcataatggaataaaatcgaacaagcccaagatctgcatgatggtagcttgctaacccgctgtatagtaattgattttttgtactttctccgatgcttctctttggatcatcctcctcatttccaaccttttcaaggaatggccgaagacgcaacatgtcctatcttcaagtgcagatatccaagaggtggttaaaatcctgggagaaaagccagagaccaccttgtgtgtcaatattgcccgtcagatccctttcaatcataaggctggttattccaacactccacagcatctacgacaagacgatgttcgaaacgagaaggagagcatccagaccttccgggatgattggatgcgtgagcaggactgtacaaagcagactccaggcgcagcgacgcagcgaagaaagcgtacgaagcggaggtgaatcggatcgagagaaatcatcgcattgagcggtgcaagccttgcattgagtggaacagtgattgtgatgggatgtcgtgctcgtcgacgatctatctatctattccatatcagacttggaacttcgactcgtagccaaatttcaaaatagtgtcatgtatattacagcacatacagaattgtctctggcagcactacagttcgcggacgcgcattctcaatcctgtgtggccaaatggccttaatcgagagttggacgcaaatcaggtggacaaacgcaaagaccggtttagctcaggcatccgtcgatatgcccacgacactcgtcttaaagcatcagtgagttgcgcgacatggaggcagatcactgaatgcattgcaaacatactcaatttctcaactgactactatctcaatgtctatccaagtgatgtagaggaatggccccttccatacttcgttcgctttcctttcgactatgcagaactttgcaaggaattctccatcatcgtcgaagaattttttcatggctctcaaaagatcacgggaaggatgcaacacaatcaattctctctggctgcacgtcctgtagcttctctatcgatgaacagagcgatgagacaacacatctggcccaaactcatggcaggctgcattgggaaaccaatacagacagtcatcaagctgcaatcaatttcggacgctgccgccgtatgcaacagcatgatgacttgaatttgctcaactgattctcactgtctacaatgcctgccgtccgtgctactgcgaatgcccctgcgccacagactgatcagcaactgagggcgataaggataaagaggggaactgggattgaaggaaacagacatcttatcgatgcaaagagattagagattacaacaaatgtgccaaggccccaaactcaactggaagatggacaggaccgtcagtattatacctcgcctcaatagggaaatttacaaattctgagcttttttttctccaggtcagcttatactgcagagccaatgggcgctgcactggtggtcagataaactcttgtcaaggatatcgaggctttgattgaattattcaagatggggcttatgatggtgtacaaaggatccatccttaaagaccagacagcgatgaaccatctgcggccgatgaatagaatccagaatatcgagacacgaggaatgaatccctcctacagtgacccatggcttcgacgatgctcggggacaaacctggttattgttgaggccaagaagagctgtcccagaatgcctgggatacatgggtaggttattcctctctctacgagtctttttcttctctcttgtgaccttctctgattagacactatagccatggtacattacatccgcaacaactgctgcgcaattgccggacgcaatattgagcccaaattgttactatcgtcgctgttctcgaagggacaatcaccaaataatgagcatcttgtgatctcgcaagacaaggacgaagtgtatgtcacgtttctattatacgataatagcaacagacagacaacgcaactctaattccttacaatgcatcaacatgggtcctgggatgttgactccatgatgaggacatggaacagacagcttgggaatattatccgagaagtgcaaaccagaaggcaaaaagagggaatcaactcccaaatggaagcacgcaatcactctttcagagagagctcgtgaggaggcaaagcatggaagagttgaataccagaagggcgaattggcagcatctcagactacagcagaaaatgctgtaaaaacgccgggtcgacggcataaaatctacccatgctatgttttctcattggtggcagaatatattgacaagtatttttcttgccagtattgacgaagctcctatccggaagcatgaatatctccctgaagccgaatcccgttcgaccacggacgcttcatcgtgaaaatatcccaccgaggttcttcgcagccagcgccgctactaacccggttcccgtttccgggctcccaccatacacagggcctcaaaccctgtctggtcgtgaacgggcttgggttcgcgagccctcgttgcgctcgggcgacatagtcggcctggtcagtagggggcctgatggcagactaaaaccatttccgcgaggccataatccacgattcaaagaaccttaagcaggaaagggctggcaacgctgtatttctccgttcaacaatcaactcgaatgatgggacacagcccgagatctgacatgctagtcgtcaactcaacacaatcacaagcttgatgttcgggttggtccaaccttctgtaccattcttttgctattggaaagctttcttgtccacctttgacagctttttgctcatctactcctcctatcgctcgtcaaaacaaacccacgacacccgtcaactttccttcctttactcgcctcctacctcctactgcgcttgatctgacaaggacgtcctctcattccgtcgacaagcgatattgatcgagctttaagatctttccaagatgaagtaagcgcccccttctctcggttgatgtctcttccactttgcatagcgaggttgagtcgccagtgccagccaacgcggctcagctgcagcggctgagtattggttttatcggactgcggagatcttcaacaaattgcgccggtggtctactgaactcaggacacaggcctataatacgatccttgacgaagtcgcatctaagctctccgatgctgtgttccacgcccagaatcactatgaggagctacttgtccacctgtacttgttgagctacgtttgtgaaaagctcgacatacgcaatcgttaataccctggataagaggattgggtctactattatcattggttccggaatcctgttgaacgccgaaagcgcaattgtattccaggagctacaagacctgagtcccaatacgtatacaagctttacagatgtctttatgcaatcacaggggggaagtgtatcatccacagcgaatactcttatacggtcgaagttcttctagagagtgagatcagaaatccagatcgaggaccgctccactactgccggtgcatcaccttgctgattgagaccaacaaaatcaaaatgagaagcgttctgtttacatacatacactgccagcaatgccatttttggcaggatgaaaaaaatcggaactcttctctcccagaaacaactatcatcgaaaaggagttcgattcaggagagcccaccgtggcccggttccttgtgccatcctcaataatggtccgtcgaaatgaacgtcccctgaatctcacagccatcgaggtcatgttacgcggtgaataatacattgcaacttgttagatactgaccgggatccgcaaaaagctattcagttcggacaccaaataacaacgcccccttgcacatcaaaaacaactgtgtagctgtccaagctgcacttgattctagagccgacggagcacaatgggccttaacgaagcttccacagtattttgacactggaaacttcaccgttatcacggatcactccgctctcgttgacgccctttgggtctggaagcagacagtttggagcaaggggatggatgggaggaaatgttgtcgttaatttgcggtgctataaactcagacaacggtatgttatctccgaaggtcgtgacaggtcctcgatgcatgtacttgtggaatagctgggctgtgcctatgcagccgtatttgcactggaggtgatgctaataaataatacgaagtacaaacagacgatttcgattagctccgctcgctgcggttctggccacttatatgtgtctgtactgccacatcaccacccaggccgatactcctttgtcgtcctgtgcctatcttgcggctgcctgggaaccatcctcgctgcattggtcattctcgagccgaagaccctatccttgctgccgtcaaacacaacggattcgcggtggtcatcgaaccactcgctggcctcgagtcgctggccggcgccgcagtggaggcgtcctgcgttggctgtcttcgcatgctctctcgcaggatttgggggttgcgccaccatcatacatggtttcaaccacacgcctttgttggaagagtcgcattctacaggatgtgccagatggcattgtcgagccgttaaccgacgagctgggatgatgcgataagcaggccaataaggcctacgacggcaactacactgagaaaggtgaatctcaccaaatcaaggagctcaaacgcattgctgcaagcctacacattggaaggtgtttctcacaactacccctgcagttaatgcattgtgctgtttctctcaaatctaccaagcgaatgtgcaagcacaatccactggattccgcaaatcgagggtctaattctctctactggaagctgctctaaccttgtgcttcgacctctactgactcagattaagatgtcaagcttgcttaaaaggctagtatgctgatcaagcgaaagaaatgggaatcatccactcacaacgattcctgccgcagtgatgattctgaacagccattttatcctgcaaactgcctgttttacctccgacaaaaattcaaagacggtcgatggcactgagccctgctccaggggcagtggatcaggtggttgtgccgcatccaacgacagtacagaaaacggtccaaagaaggtcgagctccgaagacaagaaatcagatgacaatgattccgaccctcaggattctgaggtgatggccaggtggcggaagcaaacgactccgaagccgactcagagcataccaatgatggttctggtgttcaggttggcgctcagcccgacccggacggtatacacgaggaaaacgatgaccttgaggtggatgacttcgacgagtcagatcacagggagtactagtaagcaacaatcactggctgaatcttctaagtcttttagctaatggcatccttttctttgcagtattcgcgtatttcgggacaaactgcgatgtgagcagatgggcgagggattcatgccttgaaatactccacccgacggatctcacctatcatcctatccgattgacgcctggcgcgaagccgcactctgttcatggtcagaaaacgtggccaccagataaagagtattggctacatttccatgccggagccgaaaaactgaagtgggccaaccgcgaaccagaagaagatgcgattcttcaaggaagaatttatgagcatacacagtccgtcaacggtagaaacagagaccaggtacgttgttctgattctgattgacacttgatatacaccaaaatagctgaaaagagagatcagatatacggatttttagaagatgtcttgacacatcacactgactatgctgttcctgatgacaaagtagctgagttaacaacaatctatgctgaactgcgcagattgaggtattaattgcgtcaacggtagactttctgagtggaatgctcgtccggttcttgttgacaaagtcgagatcccaacacctcaagatgaaccatgcttgacaatcaattatgctggtgttccagaggatatgcctggcaatctcctcgaattgactagcaaaggttacgatttccttctcaggctcgcaatagcacttttctttatgctgacgtcaaacgtggatactttgccgttctcctgaaccctgaagaccgtcacgtttccgcagctcccagcttcaacccacgtggatgccccagggatctcgcattgacagcttcacaatgactgaactgatgaacatcgtccttggcccgattccgtaactgaaccctgagctatttctcgtgtatgctgagaattcctatggcattccttctttgtgttttcacatggatgacatttttggcgcacatcccggcctggattccttcgctttttcaaactcgaggatagatgaactggcgcggaacagcaccatatacctggacgtgagacgacgaatgcttgacatctaccgcagggacatcctaaagcgtgcaaccactgcaacgagaagaaggatcagacacggtaatcgaaccgttcatcgaggcgatgctgtcgccgcacatatctcgattccttctgaactacccgggctctccattctggattctcgatatatctcttgattcattcttactcttcagacatcttgattttaactcctgtactgatctcgattcgtcctgatcttaccaaccacaaatctccgtccttcctcaatcaaccacgaatctctttacgggatcaccgaggaaaacgtacgcgtcggtcgttaacgccccaacgtcgcgaattctcttgaagttgcaacccaactccagatttcaatggccaaggagatattcgccaatatcgctcaccaagatctccaaccatctggattgtcaggaatagtattccttatttccctgtataccgatcagctggtatttgtgctcgctggtttgcttacgtcctgtgtggcaatcattgcgccaaccttctatttgtccctaaccctgaacacagcgctccacgaggcgaaaccagcttcacctttggcacccacctggtgccaccacacgcattaacaatgaacgaggtcgcatggctgcgagatctttcctcgccagaaacgcgcaccattggccggatggcctgatggcaaacaaagcaatcttacgaccaatggtttgccagccctgttgtggattggacatcaaatcaggaccgtgtcattactttggcccttcgaactcagcttcgcgcaaacgttgttgccacatgatgccgcatgaacttgcagaaaccccagggtcactccaaaacagattaaggatctaactaaggtcgtgcgagagtggctggtcgatgatggatggcctcatctcggtcaatctcaaggccaacgctgccgcctccaggctatggggaaatgtttcgatgaccaccaagagcagtttccggagtatctccaggcagctgatccgagaacacgcaatgaaaccctgaaatgcatcacgacaatggcctgatttcagcctttcttccctcacttctggagctctcttatctccctatcctactctatccctacctacctgattctaaacctaaggaagacttccaatggtttcctagcgccttcatcacgtgattcggacgcacctggcatagctttcagcaatacacacaccgctttagacttgatttcccagaggataactccttaagttcatcgattttaattatcctgctggcagtttgacagacgcattgttccgcaaatgatgccttagtatgtagatatggcataggtgatttcctagagaaaatggggggatcaaatatcctaataggagatcttctcagttgtaaaagacatcaacttctattgtactgtactgtacatacatacctaggtacatgcattacgtgcagacatgtaagttgacgttaggtagtaagatactgtacaagattcaactcatgcgacgcccgacattgtcaaatacacggttataaggattagggaataatcacagatgaaccggttacatggccgccagagccagagccatggcggcaccgcccacagcccacgcatggccggtcacctggggagcgcccgccttgctggaactggtagatgtcacagttcccgtcgcagcagggacagaagatgcccgagagctcgtcgacgcgctggacgcagcagatagcgacgctgaactggcgaaggtggtaggcgtcgttgtcggcgccgtcggcgtagcacccgtactggcggccgaggtagcgctcgcctccgcagcgactggtacaaaaagagaggccagaacatggctcccaaagtgcgcggtgtacattccgctccagctgacaggaccgccgacggactgcacgcaggaggccgacgtggttccgtaaagatggcagtgcaagtcagcggactcgctgaagagagtcagcaccggaatgagaaagaaaggaaaaggtcctcacccatccggaagtcccgtcatggtgaacgccaccgtggacggaccttcgaccagggtcagtccatccgtcggccattcgtcgcacaaggggttctgggatccagaacggcattggatattgtaagttgtcgccgtggaatcctgatcgcagtcagcggcgttgatcaagagaaggagagaacttcatacactgccaaccaccgacgcctccatgtccgtggggtctaggcccatcaggagaagagtgacggtgcttgactgggcagcagcacagcccagaagggccaagcacagcaggctgatggagcgcatgttgaaaattggattcggtgaaaggaaagaataatgttacaaagtcaagaatgacgaatgaacgacggtgatgttaaaagagtgacgatggttgtacgataggcaggttccagatcccacatatttaacaatttcctcccggggaatcctcgtctttaaatcaggcaaattttgacgacccaacatactcgcccggcgcaattggagcctgggtgaaggagcggatcccggggcttgcaacgttccaacatgtcggttgttgttctttggctcgcctgggcctgccaagcgccgctagaggatagcccaccgacgacgctgcaaacgatccagttcacgctgcaaaccgattgacaaaggaaaaattaggcgaaggacatagccatcctgatgaggaaatcaaggcaaaattagcggtgtcttgcgggctgctggcctggagaaaaggaagagaaaaggaaagaaaaccaaacgaaggatgcgcagttaccaagctaggcacgtggtgcggctgcatgactgcccaatcgggttagctgctatatttggcaggccccttttgcttatcgccgacacgccgatataataaaagtatccatctataataaaaatactcatctatcaaggaactaataagcagaatcagacaggccgatcttggcaaatgcctgtcgaaaggaaacttaccaacctaggatatcaccatccgtgccattcccagaaggcctgcagagcagtattctcatctcctgtttcattcaaacattcattcattcagcatcatctatgacaagatctgctgcaagtcagatagaagtggaggtataagcctatccaccagttataaccgatcttattcagaggagttggtgatattatcatttgatactggcaaacacggcagtgtatgacatgactttcagatagatccatatcttcatcaacattcccaatgacggtgtcgcaaattacgtcgatactagctattagaaaagcgtatagtatgaagagaaaggtaagataagaaaacgtatagatctcaccgtgtatatatccagacagacagggaggtatttatttctcatggatttcttcctaaggatacgaccctgttagtgaatgttttataggaggataacttctgttattttcccttgtttctatagttcttttttttggtttttctttatttgttttgtatgataaatatatatcattcttcagtatgtaaccttcccctttgttataattcactaccaggggaatcttcccttctcttgtattcccttcttccttcttttcctctttctcttctgccatgccatcttccctgctcatcctgtcatcacacctgacagcagctccattcaacctccaacatgagcaccatcagcatcatgacactggtcttcactgtcatcaacacagtgctcctctcagtggccataatgtgcctgtctctgacgaacaagaagaagaagccatcttcatttcagctaacagatcattcttctcgcatgactgactctgacttcgaatcgcgcccatcagcgctttctccgaggaatcgtagcagagatgatgacaataacaaggaggagaatgccgagactggcaacaatagtaagtacatgctcctactcctcaaccctagaatggtagacgacagcctgaagatcctgtccgagcggctgacgatgcaacacgagatgatctctacggtcttggagagccagaaggccgaagaggagaacaggagggggtttgaatggctgtgcgagcgtctcattggaatggactgagcgagtcgtcaaccagttagtaagtttcctgctgacgctggcgagagagagggtgactgagcagaggaattgattagttccactttcgtccagcctgatatcccaattccacatatctatcgtcctggtcaggtggataacatcgctacagaactgtttaatagagagtatgtcctttaaaaaaaaaggaaagaaaggaagaaagaaagggggaagaaaaaatgtattaaaaccaattatttgaactctcgtatgctaagtctctcttattgggtatttggcatttgttcacgaatcgtttcttcacctagataaacaatattgtgtgaaagtacccacgcttccttcttctcctcgcattgtttcttgtacaggacaaaaagaacagctgggccattgacaaagaagctagatggacgacaataacagctgcacctaggtgaatcgactggtcactagtttcaggtcaccaacttcagagcccgcaagccactcactcagtttcagcaacattctcgtcacgctcaccgtccaggaggttgccgctggtgcagccgtcgcagtcattacagccgtggtagctcttcctgttctcctcctccaacttgcggctctggtgaatcatcctctgaacctccagaagcatgatctgctgcttgacaagctccttctggttctgcatgagcaagcggttgctcttgaggagcaacttccggctctcgcggagcatgatctgcttctcggcgaggatctggtcgatcttggtgctcgtggaatgcgcgttcttgaggtccttggtcgagacgtaggtcttggccagcaggaggatgctggcgacgaggaagccgagcgttacggtgatgacggtgctcatggttgttgcaagggatggataaaatgataagcataggagagggagagcagaaaagagagataacaagaatgagggggaaaggatgcaagaaagaagaggaagagagattgagagaggatctctctgaggagctgaaaagaaacaagaatgcacagtgaggcgaagaaacgaacgaatttatattaccataggaaacaaaaaagaacaaaaaaggaaaataacaaaggaaaagaaaaagaaaagcaatggaaatcaccatacaaaaaaattaacaagtatgcaagtacagttaagaattagtgctacgtaggtatataccatctaccttaccattctacctattattatatctaattcagtcgtcaattatcgtcaatgtctcaaggaaaaaataaagttcttttttgccccttaacaaagctataacgtgatatatattgtggtaaattcctttgttttgtctgacatgtacggtacatcctaacaatagcgtatgtccagtatcggtaattcatagcactgactatcatggttagggttggattaggaagaatgtgtctaatggttagaattctacagagaaaacaaataaaaaagaaaacgaaaaagaaaaaaaagaaagaaagaagaaaagaagagaaaagaagagaaaagaagagaaaagaagagaaaagaagagaagagaagagaaagaaaaagagaaagagaaagacaaagagaaagaggaaaaacgcgcgagtgcaggttgcagagctcggtagatagacgagcttttttttacccccaacggagccaatgatcggagagtattgcattgaatactctatccatatgggtcaagatggaactcaccaaatactgtagtatattatccttatctagggatatagaatcttaattattatagaatataattttttgaaagaaataaagaaatatgaagataaagaaaacaaattgattcttaaaaagactagtcaattgattcccaactctcctacaccagtctcttttcagataattatcctggtatctatctgctcacgacagctcgttggaagcaccactaacaggacagcgaggctgcaggattatcgaaaaagaaaaatctataggctgggcagggcatgacccacatggaatggatgaactcgtcttgtctgcttgtcgtccgcttcgagctgctaggtagctatcacgcgatgcctaggtaacctatccaggagctagtctgtttacagccttctacaagcttatgttcagtacattaccatctgcatcttctttcgcttggcaagaagacacctgacgacgagcatagccagcattatcatcatctcctaccaccacgcctcaagcgaggattcgcattcccattgccatccatcctttcattcacccgcatcggcagagcaattaccttcagcaagatgtagacgtgcagcagcggcagcacgaaagtggatatgattttggcgagatcgaaaaggattttgatgaggcgcatgatcgtagctgcggatgctgaagaagatagataaggttgaagttatttgtcaaagtcaggtcctttctttgaatgtgtggatgaaagtgcgctgctgggggaggcgatttagatacagggaggagaggaactgaagaggtgaagagttgaaaaagagaggcaaaaaataaagcagatagatagattcagggaactgaaattcgaagattattaaatataataataaaaaggaaacaaagaaagacacaacaaaaactgggtaactgggtaaaaccagcggaaattaccgatataaaatgtaattgtaggcgaaaatgcacctcaccaaatgccatttccgtccttgaacaggaggatctgactttactaacgtgaaaacatgtttattctttttaattagatagtttcaatagtttcaaatgtatatcgagaaaggtttcctcgagaacgtgcgttccgttccaagaagcgctctcataaatagaaccagttatacttttcaattaacgaggttcttactattataaaagtactactgtaacctctaaacctctaaaaataatataaatgagtatacgatgacacggttagcggggcgcgggaaacggccgccattgcacggtccatctgccgcccctcaccgcctgcccccgagggtgatctgattgcccgatccggcttagacagggccgatgtgacctgtttggggggtagcgccggccctggccgcttttgcccgctcctgcggagcccgcccatctatataaactccaggtgcgtccctcgacggccgacgcgatccatcttctcttcttcccactgtcttccggcctgacggtcgatgccgtgcgatccgatgagtccccttaaccgagaaggtgccaagcgtaccccctgcacctccggagtcgccggcggtcagctgaggtcgatcttctggtgaagttaaggaaggaacagaagctaccatggtccgaggttctgatcctgatggccagctctagggctcggcagacccccatgagttctgcatcaaatacctccttcccctttcctagggggatctcctgggattgccaggctccctgggggttctgccatgcaattcctgcccctgtacgcccattctctagccgtgagccgtccgaccatagggtgagccctgggcgggctctctgggctgcctggattgcttcttccattggcaagaccttgatctggcctgggaatggtcctgcaggtgtccacatagtttcttcaaagccctcagacgggtcaactggcagggtccctgctagtcgccgtgccaggtgctgccctagtgaccatgggccccgactgctggtttctgcccatgcccgatcccttagtggctgctcgccaggctgagcgtgctgatccccctcccagagagtgattgggagaattcgttttgctaggtgatctcgaggtaggctgagcagcctgatggtgtaccctagttgccgggcctccagtagggtctctgctggctctaggcctgcctctcgcactaggggccctatgggggtggttcggaacatgcctgtgatagcccgggcctgccggttgaccagctgttgcaaacctgccaaccggtctttttgaccctgccaccaaagctctgccccatatagggccactgcctgtactgctgccacttgaatcctccgaaccaagcctggaggtagtccctgttgccggcatagggactgtactcgcgcttctgccatacgggccttccgtaggcgtgtttggtagtggaccttgaaggtaagtcctgcatctaaccatatacctaaccaccgggtggcttcctggctgaatgagacctggtgcccaccaactagaatcctggcccgttggacctgatccctaagctctcgtccccgcttgcgagtaaagagtactgcctcagtcttctcagcgtcgaattggactgcattggcctgtccccaggttatggcagcgtcccccgcctgctgtagcagcctgcaggtctgatctactgagctccctagggctataaggcctatatcgtctgcaaacgatagggcccgtatccctgggacagctgcctctatagccccaaagactccgctcaggtagatcacaaacagtatgggggatactggggatccttagccccaaagactccgctcaggtagatcacaaacagtatgggggatactggggatccttggggggacccccggagttaatggggtgctctgggcactggtgaccatcaactactaactgaaccctccggtcagctaggaatgatcgtacccagcggatcaggtccccatctaaccctaactcccccatccttctaactagcttggctgggtccacatggtcaaaggctccctttacatccatgaaaagagcccctgcaagctgcttctgtccccagccctggtgcacctcctggatcaggcatgccacggcatctatggcgctccggtgcctgcggctccccatttggccaggatgtaggacccccatggtttcacaatagtcggatatggcctctgccgctatcttttctataaccttccccaggcagttgagcaggctgatcaccctatatgctttgactagggtatagtcaggcttattgggtttccggagcaggatcccctttgccactttccatgcctggggatgaacccctaggcgaaagcattgcctagccaatgccactatccgggggctgtcccagctccataggagccgtagagctcggaagtttagcctgtctatccccggggctttctggattgcctggctaaataaggcacgccgtactgtctcttccttaacctgagtgtgaatcttcccacagggaaggtcttcttgagggctccctctaggggctggtgggaatgccacctcccggactagggcctccttctcagtaatagtggtcgccacctggccctgggggccccggagggtaggggtcgtacttgaagctttcggggtggtataccaaagggccttccagcatcgggtagcatcctctgggcctaggcggtccctagattccagaggccctactagaaaggcttcccagcactcccgctttgcctgccgtatggctctatagtaggtgttctaggcttcttgatgttccttatctcctaaggtccctgtctgccatgcccgccttacctgggcatatgcccctctggccagcttgatttctgcttgccactagtgttttgaataaggacatacttgtgttagtttggcgaagcagttcaagactcctatcatagattcttggatctatgaagcctccctttctatatcctcctctgaacaggcatctgttaggggtggattgctggcagcaagttccttccaagcctatatagccttctctaaggcttccctgtctgcctgaagggcctgtaactgccagccagttgcttccttaacagtctctgtagatgctttctttataggttcctatttgtcacggcgctaacgcggataagagtcacgtgaccgagggaatatcttcatcgcccagttccgagcctgctgtagctcttcgagctacgtcctgtctatagagcctgcccataccagcctgccaaacagcctgagactcgcagatagatagtgtgacgattcaacttgcctgtcgtcacgtgagcggtgagaaaagcggtgaggtataggtacggcagaatacttgcataaatcgcctcgctagcgacctggctcccttccttcttctcctctcctcccagcctagtctcttgtaatttagatcgctcctagtgataagaaactgctctattgcctggaattggatccgtcacattagactaggctcaacccactcatttcttaccatttctactgcttctagatacggtctgacgcgtctactacaacagtcgacgcagacctcttgaagctgccaactgcgtgccagcgacgtggtgatcaactgctggaagatactgaagatactaacgataccgacgtgaaagctgcgataatgctgaattgaagacatccgagaatcaggaattgagacgagacgataaataagaggtttataaaatatttaaattaatataatattaagcattaaaaataataaaaagggccttctagataatattaaaacaggtatttaaaatctacttatatattcctctacctatgattctactataaaaagctattaaaaatgcctatctctaaattaaggtattcaaaatatattaggatattatagctattagaagcaaaatataataaaacttattaattaatatcctaaaagaccccttaatactattattagagtagctaaaatattatttataggtataatttaaataagcctttaataacctaaaaataattaaactatatattatacccctatagtaggagctattaaaaatatatattataaataataaagagactaccttaaaatattattattaggccttataataattaaatatagttattatttatattaataatagtagtactactttaggagttagtattataataatatctaacttaggtatataaatacttaagtaccttagacttctttataatttatatataatttatattattaagcttataaatattaatataatattagactaagtagagtattataacccttagaatagcctatttaataaaatatattatattactatttttatagataactaaactattatctaagcttactataggctaaagaggagctctagctaatatatattaaaggatatagctaataaggttagataactctattaaaaaatatagtttataataatttattaggttcttggctataaggatattaaagtaatagattatatagtaaaattagctaatataaatcctttttttattaaagtagaagactaatctttatatactattaatagcttgaggtataggctctataattgggctcagaaaattagggaaaagggggttcaaatctacctagattgggtccctggtcatatgggtatatatgggaatgctaaagctgatgaatgtgctaaatatggagctgattggtcagaaaaaagaccctaagacctttctatctcttagcttagcctatttaataaaatatattatattactatttttatagataactaaactattatctaagcttactataggctaaagaggagctctagctaatatatattaaaggatatagctaataaggttagataactctattaaaaaatatagtttataataatttattaggttcttggctataaggatattaaagtaatagattatatagtaaaattagctaatataaatcctttttttattaaagagaagactaatctttatatactattaatagcttgaggtataggctctataattgggctcagaaaattagggaaaagggggttcaaatctacctagattgggtccctggtcatatgggtatatatgggaatgctaaagctgatgaatgtgctaaatatggagctgattggtcagaaaaagaccctaagacctttctatctcttagcttccttttcaggaagctaaaagtaaaggccttagaagaatggcaagatatatggtgtaaagccaagactagtgaccactataagcaatttaaaatgcaacctaaatggaagccaagccagttaaagttgactaaacaactatggtcatctattatccaattaaagctaggccatgggtactttaggtcatacttagtcaggctacctgcatataatagtggaacctgtaatctatgccaaaccaatcaggagcaaaccccatatcacctattattccattgcccagcctatagggatatcagatatagagctttctctagggtagatagaaaagattataatcttttctatgtattctccaaagagggtcagggagctttagttcagttcctaaaagaatcaaaaatagctactaggaaatggcacctaggagctaatgactaagtgagtcaagccctactatactaagctctatagatctactagtagaaccctactagtctaatctatagtgcctgagcttgctaagcatagattacctaatcatgcttactaggctacctcccctatcttattgactacccccttcctttttctttctcaaacccatgtatacccaccactccttaactttctatttctttatattatactactgcctaactgccttttatttcctatttctgccgctcatagaaggttcccactgttgactggtctatagcataacccacctgtatatagatattagccactaagccctactgcctaggtggtaggcagagcgtgcatagtctctgactgaaaaacgccctctaaaatggaagaataataataataatataattgctcttttactttctttcttcctttacttatctggttgctatttatagttcattagatacttatagatattttaataaaattatgaattattaaaaaattattttattaaactttatataatatttatactaaaataagtatagtataaattaatttattttattttaacttttattaattatatatgattataatatattttatataaaatattaagttctttattaatatcataatattttaattattataatatacctaagggataaaagtttctattaaaacctattttcttataaagttaaatatctaatagcgttatttttaataaaattatataataaggctattaataaaatatatatttaattaaaaaattagtaaatctattttttatacaattttattaagaaataaagccgtaaaatattgaagttttatacgaaaataaggttatagtaagaatttttatcctaatactatataaagctataagattaaatataagcttatataaattaaggttaaggttaatatatttaataactattttatttttaggcttttatctgaaataattaaataaatattaaagctaaatagcctttaataattaaatatattttagattaaaaatatagcttaaattattatataagaacctcttttatttagttatatatttatatataggtttagactcttttataaatataaacaatatctaaaatatccttaaaataaaaaggacttaattatcaattattttagaataataataaattattaagttttaataaatgacttaaatttataaaaattaaaattttaaatttttaagtgtatttaatataaaatattaaatccttagtaattataacttatatactatctcattaggctaataaaattagcttaagttattttttcagtttaattatttaatatatattttattaggtccttattttatattaaaaaagtattaaactttattaaatagattttttaataaataataacttatctttatttaaaaaataatataatattaataattattatattttttaattaaaaagactataaatattaatataaattagcttagaaaggtattgcggacttggccaccttcttgatgttgggcttgaacccgggcgtcttcttgtgctcgcagttggtgcagaacgtgagcgtgacctggttcctgaacttctccggattctccttcgtgtgctcgatgagccacgccttgtcgtacatgtcctcgtacgtggctccgttcctcttcgcgtcgtcgtacgaggggcacgagctgcccttgttcggggtcacctgcgcgcaggcgaggcacaacctgatcacgttgttgcacatcgtcgtgttcgtgttcaagccgctgctcgtgttcgtgttcgagttcgtcttcgtgtatgtgctcgggtgcttcttcaacttgttccttgttttggcagagcaacgatcaagaacggcacgaacaacctcgtctagtccgacgcccagtccaagacgtccgtgtccgttcgtctgtccgaccaggtccatgaccgtgaagccggtcgcggacgcgtcgttcctctccgcctcgggggcgctcgtgaggaagctcatcgccgcgttcaggtccgtcatcttcgtcgtgatcaggttcgtgaccgcgttcaggaacaagtcgagtagatcctcgggggcttcgtcaacgagtaacctcgtcatctgcgagatcgcgttccccttcatgaccccgaagatgatgtcgtccctgtactcgtaccactggaagctcgcgttgacgatcgggtcctcgagcacgcccacgcccaaggacaagaagcagggcgcgaggaagttctcgcagatgatgaaggagaggaaggcgagcgaggaggaggagaagcccccgggcagcgcccccaccgacttcacgaccatgaccatgaacgcgcagccggggcagaacgtcagggcccgaacaaccagacgctcgtgctgagcggcaagctcgtgggcttcaacgcgaacgagcccaagtggacccaggaggagctccgcgagttcgccgccatctgctcgtacaggatcccgaccatctcgatcagcgagagcaggaagacgatgccggacccgaaccagcactacgtcgtgaggcggccggacggctcgggcgcggcgacgcaggcggccatgttgccgaacctgaagctgaccgagttcgtgctcgggatcgggcccacgaagccggacatgaagctgcccaagaagaggatgtactccgacgtcgtgatcgtgggcaaggaccgcgactggatcctgacgcagtggctgtccaaggacgtgatcatggagccggtcccgagcactgtcaggaacaagcaggagcaggcgaagaacaggcagagcaagcgcacgatcagcgtcaacttcgcgaggttcgggctgcccatcaggtcgttcggagccgtcttcaacaccctcaaccagaacatcggggggctgatggactcgctcgtgatcacagacggctactactggatggttcagtaagaagacaagagaatgcatgttctatgactatgatatttgacttgacgcgtaggtatcctaggtccccagttgctgcggggacatggacgtatgatctctgtagtcctctgtccagagcagaaaaaggtcatcagtctcaggcctgactcaagcgtgggtttgttgtccaaggtccgatgaggttgtagatctagtgtcctacggtagttgatgtaggtgttgagacctctatatcatgtcgtagtccaactgttttaggtttgacttaccaaggccgcgagtgtaaggcctggtgggcaggtccagggaccttactctttctgcctggcacggtggacagaggacccaacaggtcctgggaccgcggtcctaggaccggcctgggcaagggaccgacaaccgctggccatgctggcctcaggaccgccgaggcgttgggaccatctaccctcgacctttggtgactcaggactactgtcaagataccacaatgattacaaattggccagcaatattacacgacgctttgtccttctccctatccccgtgtcagtctcgagcgtctgtgagacggattccatcatttcttcgttgataatcagtttaccctcgagagctatgaagacagtgctggttccatcctctatcgccgctcgaaagcactgcgctggagtgatctttcgtagtttcttatcgtagaagttcggcgtccagttgctgcataggtcgatcaggaggctccgcagcagcgctttcttccacatttttagggaacaaccgtgggaggaacactagccgaaggttttagaaaatggtactccatacgtgtgattcaagtcgtccaacagatcacgtgatttaaggaaaatgtggaagcgatggatgcttaactagttgtatggggtgccaaactatctaggaatctagctcacataatttatgactaagcgaggtcgacccagggcaggtggcacaggaagtccatatgctccgacagaaaatgtgttggaaaggggtgtattgtgtgttcattggtggaggtccggtggacccgacgtctaactagttagttagttctttatgattagttgcctcatgtggtgaattgtgccccacaatttattatattgagaaaaatcgtggccgaccctaaggttggcgaacccttacagttgactgcagcgcactgttacatataccacatggcttgccaatcttggtaaaattgtggtccgccatatggttcactatcccatacgggaattataccacatgggttaccataattgattagaattgtagttaactatggggttggtacgcccttgtggttgtttacgacatacggttaactacaccgtatggtttgccataattgcttaaaattatggacgcccatatggcttgcagacccttcattttcaaatggtctttttctttccaataagagtctgagagaacaaacgcttgccccagttagaagcggtgttaacagtgggcggctaggaacaaccaatagccgcaagcctgcagaagtctgccgcgccaatagaagattataaataaatcaaaactatttagtggtcatatcacgcggagtcgtttggatccggcgcctctatccggcacagtgatctcttgagggtggccatgcgcttttcaactggttggcaatccagtgcgcaccgatggaagtaatgattagggcctgctgtaattcagaattcgacagaatattatccggccgcaggtctcgatgcatgacatatcatgcaagttatcagctggttnagtcccgctaagccagttgatccctttgcaagatgtcatgtaaatcgattagccaaaaacagtccaattttatctactttctgggcgggccctgctgcatcaaaattacaaaagaacgaaaaaaagatcaatgaataaagtagaacactacatacagtactgtaatgcattcctgcccatgttggtcctctgcagtgcttcctgctgtctccgggattcgggaagtgtgtaggtcacgtgacttgattccaacttgccgaagcaacctcacgtccggaaagcggctcgagtttgcacgtctaccgcaacccttctccgctcccacatcctcactccaacgtcacaatggctgcctctgtatgtcaattgcattcctgttgcctttctttgctggtggctaggggttatggtttcgctgactgccaatctacagcgtagcgccgctctgaagatcgactgggccaaggtgaccagctcgttgggccttcgcggccagacggctgcgtcgctgcaggctttcaagaagcgcaacgacgatgctcgccgcaaggtccagatgctgtctgagcagccccagacggtcgacttcgactactaccgcaaggtcctgaaaaaccagaagatcgtcgatgagatcgagaaccacttcaagaacttcaagcctgccacctacgatttgaaccgccagctcaaggctatcgaggcctttgaggcccaggctctgaagagcgccgaggagactaagggcaaggttgaggccgagctggccaacctgaagaagactctggagaacattgagactgccagacccttcgatgaactcactgtggtatgtggctttgcatcgcgacgggatcgcgggtttcccagtttcacgcggatgctgatgagcctttctgtacaggacgaggttgccgccgctcagcccgagatcgacgagaagaccgcgtcgctggtgtccaagggcaagtggatgccaccgggctacaaggttcgtgttcactgccgtcattttctccgtgtgtgttattctacagtttgctaacggttcgccacctacaggagagattcggcgacctgtccctgctgtaaacagtgccgacccatatcgatctgtgtgcatttaccgtccttcttcccatgtgaccataccactatatcctacctgtcaaatcattggggccagccagctggggatgtgctgtgtttggctacgtgatattggtcaaatgtgtatagaaccattgtttcaattagatgaccgttcctagaccgacatctccatggccttatccttaggggaaggcccagtatttgtatctttcgcggagagcatgcctctctcgagtaatcgtggttcctggggaaccaaatagcatgctatttttcgagcttaaacgattatagtgagaagttgcacggaccaacgtattccatggctggcttccctgctcaacattacattgatacaatatccatcttgccagcagatgcctgctagtagtgacttgcaagcgtccatgacaatgaagtcttaattgtcgagtatgacaacagaaccgcgtatggacctacatactttcaagaaaagtattgagttgaagggtccatgccatgtgagcgataaggtctgccccgcgtccagtagacgactcgaaccagccatacacgtcagaggatgctcctcgacggagtgataaatgctcgggattaattaatgccaattgctgcaatgcagtgacttccctaggtgcatacttccagtccttatcatggcaagactaagcccggatttacaacatatgtcctcaaccggtggcaccacttctgaccatacctggagaccataatgacattcgtcatcttccttgaagattgtctcctttttttttctctttgcttaactccatagacaggctcgttctgctgagcaggacaaatgatgctcagatgttgggcacagatacggatttaggtcttaagacattaggacggagaacagaacatgtacttcgtatgtccacaacggagatgtctgcctctttctgtgtgtctcgagtctttatatatatccagaggatgatcactgtctgtttttgagggtaaacggtgtgagtaatggatatgcaatgctgccttggagttttgtgggaagggaagatatcaggaatagtacgcatatatgccgcgatgtatatcggtactcaggccctaactccgaggaaatcatcttgagtgagttattcagggattcttgcgaaatagacggcgtgtccatggccagttgttcctcgttcgccaggtcagtctcaagccaatcaagattcgactgtcacgatccagtgagtactccggagtacggacgggagtgcgctgtcttcattgttccacctgcaccgaggacatacgcccattatcgccaatcatctgcttcgcggacttgttgctcatcatatcaaacaggactgccaaggtagcgacgctcaagttgagtggacggctttgtttcgcaccacctggcgatcgatctggatatagatatacggatgcgtgcgttgcgagaaatctccatgaatctccatgatctatcgcttttttcacctgcaacctcgttacgtctgctaaccttacctccctccatatttaggccactattactagactggaaatgccttctctgcaactcttcttcggtggcaccgcgtgttagtcacaccgcctatcctggacaacagcactccgttctcgtctctccggtgtacggagtccttcatccttccccagttcctccctccagcggcactgcggcaggggctggtgccgccagcggccagccagacagtgcaggttagctttgcaggcgtgcaggccattgcagacgggcgaatccgattgctagggcaggcggagcacaaccactgcagcggagacgattcccagctggccgggacgccgagtggcttctggcaagggctaaggggtctctggcaccccttgggcggaggggtgggtgcattcagcgactgctccggtcgcttcagtagtgcagccagcctgcaagcgaacgctgcagcagagcgacggtcccaaacacgcggcccagccatgaggcctgagcggcgcccgcggagaaagccagcctgtcgggtcctcacattgtgacaaggacgcaagattcgtcaacgttcgaacagtcgactcctctggccagcacgctcaggaggagcagtcgagaacagtccccctcttgctgcgagcagcctgcaccggctgctttagtcgttgacgaccatcgatcgtccttgcccagtgagaacgggcaatccggctctgtgtctccatcaactaaaccatgacggacaggatccacaggcttccgacgcatccctcccgtcaaaaccgtccgcctggccatcttgtccacaggttcccccagtgggattggattcggcagtgtccactcccgagacttggcttgaggaatgaaatatttggtttcatcggctggcacttctcgaggcgttatcgctattttttttcccttccctgtttttttccctgtaatttccccgcatcgtcgtgctcacacccgtcgtcacattaattaatccacgattgataatcaatccctcagtcgatcacatcacccagcctgacggtaactaccgcccgacgtggctcggaaccagtcaaactccccagccttataccactccaatcaggccacaggcacgcggtggttgttgaaagaatccctgttgtccacttcatcgtgcagtcccaaaaaagcccttgtctgactacttgagtcagcccgtggaattcggtcgacgcatccgcttctccgggtttggcaattgaggctcgaatcccgcatgcttggtcgcgctaatgtttactaggctcagtagcctcgctgcctcacccagcagaggcacagttgggactgtgaggcggagggcgcctgaggctgaggtctgcagacatgattctggagtactccggagtactccatcttcagttccttgattgcggtgccagcagagcttcgccatccctccttcggatggtaggctaggaggatccatcttggatcttcccctgcattttatttccttttctgtgcgtcgctcgttcactcatccggccctgtccgctccttgcagcagtcctgccgtcccccgcaacaaacacggtctgccacctcaaaactgccatgcggggcctttggtcagggctgctccttacgagcagcctgctgccagccgtcaatgctgatgagacggccactcccttcctgatgaactggggcgagtcggtcttatggacctgatggaccatggcaagccgtgaatgttagcattggcacctcccgagcagcctgtgtcgctatatcctggggggatctggggcagccacatcctcacgacatatatttgtcagaataaatcgctctccccgacgtgttatgggcagcaggcgggcctgttcaaccctgataaattctctaaattcaacaaccactcgatcgcactctacgagagcggagagatcaccaccggcgtccatgccattccgcaatacggctttatgaagaatgccatggataatatggatataggcggagttattattcccaatgtcaccatcatgacggtcaccaacacctcccagacataccctagaggtcaaagttatccggttgaggtgggaatcttgtcccctaggcgctcctcgttacaacacatcctacaccgaaaacgacggccgcccgccgctgaacacgacttttatcaacagctacctatatacgaacggaggcggcaaggctattccgtcgtactcgtacggattgcacattggatcggccgccttgaacatccccggttctctcttcttgggcggatacgaccagtcgcgtgcgctggagccagtgtcggcccaaccctatacctcggcagaacctggagggtcgtttgcgatcgagcttctcgatatcgaaatcggagtcgccaccggaggatctccgtggaacttcacgaacaaaacgggcctgctgatccagggagattccccctccctcaagtccgcagacattacccgtgatgttttctcctgttaacccttacctctatctgccgaagagcacttgtgatgccattgcggccgagctgcctgttgagtaccatgccgacatgggtctctattattgggacaccacgagccctgagtacagcaagatcgtgacgtcgcccgcatacctcggtttcaccttccaactgaatgcactcaatacggccaactttacggtaagagttccgtttgccttgctcaatctgaccctcgaggcgcccctggtcagcacgcccacccagtatttcccatgctttaccagcaacgggacatacgggctggggcgtgcctttcttcaggcggcctttgttggcgtcaactggagcaatgatggagtagggaattggttcctggcccaggccccgggcccgaattatcaggcgactccgtcgaccacggtcatcgcgccgggcgaccagtcactgacaggatcccagaacagctggctggacacctggacggggcactggacccctctgcctgagccttccgacgtgagcaatgcaaatgcagctgagtcgtctgctagtagcagaagcggcggtctctccagcggtggaaaggcaggcatcggagtgggcgtgagcgtaggcggtctgctcatcattgccggtgttgtcctgtgcctcctccggcggggtggtcgccaggaagatgcgaccaaagcagaggccacgcctctacaacccaacgcggctatggttgctcctgctgcagtcatggagtcatacaagccatacggggacatgggcgcgagcaagcagacgtacgcatattacggtggtccaccaccggtagcgcctgggtcggtgcctcgggcgcctgtggagttggataaccacagcggacgcatccacgagctgcggtcgtagtcactccacaaaaaaaaaaacgaaaaacgaaaaggaagaaagaaaagaaaaacaattcctgtcgcattcatctgacaggacgactgacgatgtcatgtcttggaatgcatttttgcactggccggagtaattgactgggtttggatatggaattggatcgatcgtatacccatgcatgcctttttttttctttccttttgagctgtatatatatttctgtatctgcagccagctaacagcaacgtttatatacctacccaagtaatgtatacaataaactatgggttggacaccatgagtgtatgtacatacgtacaggcagaaataatatttttacacgagtcttattattattattaccacccctgagttttattttatactccgtacaagcctttaacgactcgctccgctcgtctaggcttgaagggtaaagaacacctaggcttactaatgcctataaatgctccggaccttcggccctccgcatacctgtaatataagcctatatataaagcctataggatgccagcatgaagcctataagggttccagcgtaaagcctgtaggggttctaatatgaagccttttaggggtgccaatgcaagcagagaacagctgcggagcttacataatggccacagcgggagctgactaactagttaactagttagttaactaacgtaatccaccaccgagctggtcagtccttggccaagagttgcagcccaacgtgaccgaaaatcttgaagattattgcaacaaaatctattatattttcctatataaaagaaaaggcactatttattaggacatttaagccgattatggccttcttgattgcaattactgcaccttggtggtctccgtggtcgtcgagatgattcctgcagttgctcatgctcttgagctttttgctgcccttcagcacctgtcaagcttccccctgcttgaataaaatattggccaacgccgccgccggcaacggatgggagaagatccatatccctcacgaggaggccgagttcacgcatcgccgcagtggcaattcgaacaagatgtggctcgcttttcagccgtattatgatcaggtcgtgaaagaggatccatctgtgcttgagtaaatgtcagtagaacggtcgctagcaatagcggaaaaatgtaggatcatctgaaatccgagaaaaatgtgatctagtacccaatatcagttatagtacatacaatacatgtaaatgacacctcatatatcggccgactcctgcatgaatccgaatagtaggtccaaatcctcaatgaaaggctgctgctccatcgtgctcggactcagcatcgtttccggaaacatctgccggctcagatcgacgtccagtgggaacgagtcccccacgttggaaaccgattctaatcgcatcattagtaataacacatcaataacagatcatctaacgtaataacggcataccccttccaactggaatcccgttggcctccatcagccgccggatgatcttggccggcgccgacactccgcaattcggcaccgccagctcgtccagacagcgcagacacaccgtcaatggcgacgacgggtccccccgctgcgtgctttctcgcacggcgggattgcgcgcgtggatcgtgcaggccacgtagacggcgtagctgagcatgtagttcgctctccgcagggagtaggcagattggtaggccagcgccaggctcgtgatgttccgggccgccgtgacgcagcgttcccaagagtgtgcgggcccattcgtgatgaacggccggtggagcaggatcagaagcgcatggtacgtggtgagaaggatgatgccgttcggagcggccatggtcgggccattcgaagacgacgaatcttgtgcccatggctcaaaccgcagttcggacgggaggttcttgtaccacgtcaacagtttctcatccatgtaatcgagatgcgccctcgtcttgtccggcgtcgctcccacgacgtagaagtgatcgatgatgctcgtcatgatcctggacagcgagcacagctgctgaaaggtcgagatggagtacaggcgaatcggggtgggctgatttatcctcgtcgtgggcagggtgggatcgacatacggcgtccacagttcattctcttcaaacgtgtccataaagtcccacgagacatgggtgtctcgaagctggatggtaaacggcctcccaaagtagagactctgcagtttatcgcagatgaaagcgccccagaagacccgccggcgaatctcgatatcttctgcgttcccggcgacctccttgcagtccaggtgcagacccaggtcatacaccatgcgcagggcgtagcccgtatacagccagcccttggaggtcatcccacgggcgttgaaggtgctgcccagcattagaagccccgtgacggttgggatgctggaagactgcagcagattttgctgcgccagcaattcgtcgcaccggtcaaaaaaccgtttgcccgccgtctctggacggtccggatcttctcgcacctcgatccgctccgagaacttgctggagcacgcaaacaccgcgttgagcaggaattccgaacagtagggtccccccctgggcgaggtccctcatgaacgccggccggtacgtgagatgaaacgtgtgatgctgccgattccagtgcaggtccagcaggtgcatcgccaactccgaggggatcccgcctatcgtcggcagctttcgcagatcgtgttccttctgtcgctgcagggcggcgttggcgatcagctggaaacggtctgggtcggaggtcgcccgggactcggtcgagtccggcatactggtgggactttcgatatggagggccgaggtagggccaaagatgcggacgacgccgcactcgtctcgggagatgaacgttgagatgttctgtctttcatcgggcgtgaggccgtcgcgatcgtcctgtgcgctcggcgggccgctctgctttggggggcgcttgtcgtgccccaagtcattgagagaatctggcaggcggaggacgccattgtccagggagatggaatccaggatggcatttcgctctgctggatcagcgttcttcagcgaaaccagaatcgcctgtaacgtgcgcttctctcgttcggccgcatcgatcagggccctcgatggtctacagcggtcagctcggaagaaagacggtggaacgctcggatgggtacctctgcttcggaggatcagctgcatagacacaatgccggcgatggatcagacacgatccacacggtcgaccgtggtcgcatcggatcttgcgcgcgcggcagaactgacacgcccggccggttggaggatgggacgattggcgtcgcacactcataccgttcaaccagacaagaaaaagctacctggagatacatgtacgtacacacgtagataaacgaaagctctgtgcacagcctagttatcggaaggtaccgaacgatgcggagacatggggataaaactagcgtcgcgaccccgcaaaaaggatccatctagccagtttagtctgctgtcgaggaatggtttcgctcgatgtgattcgacagtcttgtttggcagaaagcaattatatcagcctgtttcttcgatggatcttttcgattgagaattgttagcgtaacagggataagatagttgatgtcagaagagcagctcacgaatcaggcaactcatctgcagtccgtcgattccatctttgcattgtcctggacagcattattgaagatgtgaggttgcctttagatttcgatctaagctggtagcgatcttttctgctgctgaacatcgtgatgtgtagtgaggaagagcttggattgtgagaggcgagcgagtcacctgctggtgagtggtgacccagccagccctagccccaggccctgagccctagtctaggcctgccttacagaggttgaaagcagaacgttatccaataactaacaattttttcatcaatattcttgcagtcttaccttattgtgcagttctagatgagcactcactcctctgcttcctgagctactgctgatctatatttatatgttattaatttgcttattatgcaagaatgacttaatattaatatcgataaagattagcttgtatcataacagagaagggatgattaaaagctatcaaccagaaaagctccaacagctaaagaccgtgtcatgacactggctgaatgaaatacggcttgatatagagatggatgacttgcggtcagctgcagctgacagatggaataaatcgatggtgatggaactatcttacagacattgtctaggcggtcttttgaattcgatataccagtcaacggcgataagacccctgctcctgcggctccaactcctcgccatcgtgacataacgtccagtcctcgagaggatacgcgatcgctttcgtaccacgggctggctccaatcgtctgccccccagccaatgccgctcgggaccacaggtgcactgcatcaccgtacggtcaaaaatcaccacatcgggcatcttcgtttcgtcggtgaacttcatacgatggaacacaaagtcggggacccatctccgccagtacacgcgcgtggtccggacgaaccaggggttgcctagcgggaagaggatcaggtcgtaaaggacgttcatgcgaagcccgtcgcccttcggggccggaatctcccatttgcagtacgtcaatgggcccatactatcgatcagttggaagtagcccagggacagggccggcggctgctggactagcatccggcgccagctggcttctttgcggaaatacgcagaggccttcttttcggacttggccaggtcgagcgatgataaaagcggacgcccgaggtcgaagcaaagttcagtccagcagaagaagaagaagaagaaggcgggaaaaaagggggaagagctcggccaagagggggtttgggacctattctgacgatggagtagcaggcgcaggcaggaagaaaagagcccgctggatggatggagagtgagcgatgagctccctccatcgccggcagaccagctgggcggaggtgaggagggtccgcatgtcgaggcggaggaggatggcttcgagaagctcgggggtggagaagactctgtgggaggctctcatggttgttatgagttgtttcaaggaagaagaggtcgtatgtgttgatacagatgcatgttctaacgagctgttcagcctcatatctcgatctgcaccaacacggcggcattgtttcaattggttctggatcaagaattaatcaggcatccagttgcctcaacggtcgacctggaattagtagaaagatttatatctgtatatctgtatccgtggtagatctttgctcgaatcacttaggactgcctaatgcggtatatcagcagaccagacgatcgacgattgtatcctgcaatgctaagaacaattttcagtcttgtacgtcagaaagatcttgaattggaagggtactttcttctcttgttttcccaagaaatgacattgttctatccaaatggctcattctttctttgtttcttctttgttgccagggccataccatttctctggaatgaggttgtatagcgccgcgagtcaagtcgaaacagacaaagaatacggcaatagatccatgtattttctataaacaacaaactaaaggagactatactacagactagactatataagacaggatctgcctatctagatctgttcagtgtgcattcaagctgactataagcaaactgatcgacacaatatggccaatccatttgtcgtcccatcaggctgaacgctgcatgcagtcttatggctgagttcacgccttaaacagccgcagaggctcttcgcagacgactgtttgtctgaattgttctctgcttgtcttcctgctgacagataggcgctgtctgattggcctgccatatcgagaccgtggatataaaaacagacgtcgcgcttccaggcagctgtttactcgactgtttacttctacttgactgcaaatctcctgatcgtcgactgcggtctgtattctgtcgacgacactgcagtcaccaccatggcgccaggctcgcattctacagcgaacttgacccatgccaccgattctgcgtccctccttcctcctgtcgctgcaagaccagcaacgtcgctcgacaattctgtctaccacagcctgaccagcgtcctcgaattcgcagaccaggaccagctcttctggtggaccgaaaccgcgtcgatcgtggcaaagctcatggagagcgccggctacgacgtcgagtctcagcgtcgctatctcctcctctatcacgcgcatatcctcgccgcgctgggcccaaaacaaaccccctgccccagcgacagatctgcgagcagtccctggaaaagcttcatgacagacgaccacacgcccatcgagatcagctggaacctgggcgcgaatcggtccgtcgttcgactgagcatcgagcccatcggcccttttgcaggaacctcattcgatccgttcaatcagcgaccagccctcgagctcctgcaacagctacctggcatcgacctccagttattctactattttagagactggttcttcatcgacgacgacgatgttgacgacgttctgaaaagacgacctgctggcgagcactcatcccagctgtttgtggcgtttgatttcgacggcggaaaggtaacgacgaaggcctacatttttccccttcttaaagctctggaaacggggatacctgttctggatctggtgtcgacggcgatccgcaacctcgatgagccggcactttccgtgtcgccagggtggaacgtcttggaggatttcatccgttcgtgcccgattgcgtctcgacccaagttggaattcatcgccattgactgcgtagctccagagaagtcgcggatcaagatctacgtccggacacctcacacggcgttggagaaggtcaaggacgtctttacgctgggcggtagactcaacgaccagacgatccagactgcgcttggcatgctggaagagctgtggcgtctcgttctggatctgccggatggcctgcgtgattcggacgagttgcatccacgggacgaaaacagcgctggccatcgcacctcaggcgtcctgttcaatttcgaaatcaagcccggggccgcgcttccagaaccgaagctgtacatcccagtccgccactacgctcgtagcgatctcgacattgcgcgtggcttgacggcgtttttccgtcgtcgaggctggaccagtctggcggagacgtatacagacacgctgaaggaaacgttgtaagtgggagaaactctgtcaatacattgtatgtacttccggcagccgctaacgattatgcgcagtccacaccatccccttgccgagtcgacgagcacgcatacctacatcgtctttgcattcaagaagacgacgggtgtctacctgacggcctactacaacccgcaagtctacgccagaccgaagccatcagagaagctggaatggacgaaagaccgccttaggggtcacaggctctgactcacaatcttcgacgtcgagtatcaactgtgacaatagattggccttggacttgtcttggctgctatctggtcatccggcagttgctgacatcagaacttgcttcaagtacgtatggtattctgatgtactgtttcagtgctccagatagtaagtacatagaacttcttgcttgaataaaatcttcactggaattgaatgatccagttgaatgcagctagcttgatgtatgtacacgtacagttcatacctacgtcagcaatgcagcaataattagtcttattccgtcaactgcagctgtcagtcattttcagctatatatcctacgccgccaccggtgcatccggatcaggattattaaaccactaccctgaccgcgctgccgtacgccgtgaagttgctgctgctgctgctgttgttgttaatatttcccggctcgagttccaacaccaccacctcgtttgccccgacgtaagaatacaccccggcacgtacaggctctgctgcggcccgatgcgccagtaccggcccagcttgtgcccgttcacccagactacgcccttgacgccgtccggcagggagaggaaggtgtccaggttgagcgcgggcttgccctcggcgttgtcgacttggaataagccgcggtagaagagcggggggatgttagcactggtgttggagggtggtgcagctggagctaaaacactgatgggcagctcgtccagctgcagagagtgcatggcccagttggtcaggacggtccccccgacagtgacgttgccgacgatgcctttgcgctagtccagcaaggcttgcccgtagtcgatccggcccaggttctcgaccagcagctgcagcacatctccctttttgcagggacacttgcaccgtcgcgggcgtctcgtagatcctgtcgatcacgcccacacgctggccgttcacaaagaccatgacgcggtcgcgcggtccgtcccccggcagaagctggccctgcacggccgatttcgccgtgtgctcatacagcacgaacccgtacgactgatattatattaagacgagatgcgatagatgcattcgggacgagcggtgatgacgatgatgatgatgatgatgacgacacccttgtcatgtcttgtgcaacataagaaatcctgactatccaagtcagaaaggaattgcgttcgttcggtcgatcgatcgatcgtcggattctgtcatgtttcttgtttatatatgtgcatttcttcgagtcaaatgaccagcacgtgcttccagagatatttattcatcgtgactcgactcgactcaccgacttcgtcgcatgtcctccaggtgtcacaaactaggtaggtaggggggatggatggatcctcagggaggcttcaagaaaggcccccatttttcctcgtctttcctattaaattctaaattgaactcctctttattgcagagacgcatgaccatgaccatgagcaaatgtgcttgcttgctaatgctaagttacactacatcttcatcgcctaggcaattaaaattctgcacctgcagtctactttctgtctggccccaattgcttatgccaaggcatacatgtatgtatgtatgtctgtacatgcattacttacaccctgccagccagccgcatgctgttgtgtcccgtttcactagatgttcttgttctggaaggctctgcgagatggagactggcacgcgcgtatactggagatcagatctggccccgaggggatgcaggaaatcatggacctggatccaggtactgtacatttactgttgacagaactgactttaaattagcagatttatagcgttggtcaatccaacagctgccacaggctgagattaacctcgacatggacatgctagaccctgcctatcacaagacagacgcaattctgatcaaggccttccatcagacagcatacggtccaggtcaagtaacacagatggcaggaatccctgcacacgaactgaaattgcggatgatgtcgagctgaaagctgaaaaatgcatggcttgtcgggaggatctataaaagaatgaatgtctgtcgcaggatcagccggactaaacttgtcatatctacaacagtatcatcttctgccgactatgtccaccaaaaaaaccccccagcctccacgactccgctcagcgtgtgacgcctgtcaccaggccaaagtgcgatgcaccggcgggtcaacctgtctgcactgccggaaccacgacctgcaatgccattacagctatgcggcgcgcatcggcaagccgaaggggagccgcaatcgcaagacgctcgcccggctgcagtgcgcaggacgccaggaaaacaggacggtcatgtctgtcgattcaggacagagttcttctggtcttccggctgtaccggtcgacagcgccctgtggaatccatccttggttgctcctgcgtggactggcagtgagaatcttccggtacagagctatccactgccttcccagcaatcgcaagacagctatagctggctgtggcaaccgcttcctccttcgccgccggagagcgtcaatgcctgcttcaacacgcacatcccaggagaagcagtaggtgaaagtcagggtcttatatctgccaacaccggcaccgtcgatgcgtacactccaggacacatgccatgggtgccaacttccctcccaccagacgataacctggcagaggacagtagcagcaacagcagatgcgactgcgactgtctcgagaggcaaacctcgcaagtgatccatctgcatcaccacatgcgacgagatggagaacaagaccaagaccccttcgacagcggcctgcagggcctcatcacgtcgtgtctgcaggtatgtcagaagacccttcgatgccccttctgcgagaaggatgcgtcgacggtgttcttgatcgtggcatccgtacagatagcattacgacggttggaggaaagcctggtcggactattactgatggcagagaaaccgccatcttcatcgtcgccagaaggaacaacgccagacggaacaccgcttcgaacggatcgttctaatacgtattactacatcaagcagacgctcctgcgtcaagcactctcccaggcccaggacaccttgcgagatctgcagagcgtgatcacaccgtcgtcgctggacaacaacaacaacaacaacaacaacaacaacaacaacaacaacaacaacaacaacaacaacaacaacaacaacaacaacaacaacaacaacaacaacaacaacaacaacaacaactcctgaacaacaacaacaacaacaacaacaacaacaacaacaacaacaacaacaacaacaacaacaacaacaacaacaacaacaacaacaacaacaacaacaacaacaacaacaacaacaacaacaagagcaacagcagcaacaaagaacaaaaaagaaagaagaagaagaagtcgagcatgtacggcatgactaagctcgctctgatggtctttgccaatgccttccagaagcacctggcatcctataaccggccagacaagaatcctgtgaacgcgcatgtaatgatcgtcgacccgggattcagccgcacgccgggaatgcgacgctggctgaccggcggctctctctggggcctcttagcctacctactgacctggccgctctggtggctgatcctgaagtcaccgcagcaaggcgcgcagagttttctgtacgcggccatggacccgcgattcgcccgcggggagaacactgcagaccggctgatcaaggagtgccgagaagtcgacttcctgcggaacgaagtcagggacgagcaggtggccaagcagctgtgggaattcagcgagcagcagatccagaccaaggagaaagaggccgctgtgaagcgcgccttggctaagaaggagaaagagcaggagcagcaaaagcagcagcagcagcagcaaaaacaaaagcagacaaccaccaataacagtaacaataacaataactcaaccagttcaagttcaagcacagcagcgaaatcgcaaacgccggggtcgaaaaagagtcaaaaggcgaaatgactaaatgaatgaattgcgtgtgcatgttgtaaattttttttcttacttcttttttttttggtacctgtcacaggcagcatcttcgatatctatatttatcactatcattatcataccaatgttatattatacaatataatgaatgactgaatgaatggatagactagatgataccagtgtagttaggtaactgatgactgctacagagtacctgatctcagcgtgcatgagcaaataaacagatagatggacaagacaggcaaaatgataagaataaatataaataatggtaatggagaacttgtaaacagacggcttgaattcaattgagcgctatctatagtggcagattctcaacattgctatctttttctgtctttctttttttctctttttgtagtgtatcttcctgtatgtactgtacagtacatctacaagatgtaaaataaaaaagaaaaagaacagcaatggaaataataataataaagagaatatggcgaaaaaaaattcaaccactatcgtcgtattcatagatggaacaggactctcattgtcattgcaatgatcgagtcttttttttacttttgcctagacttcttgtctagttcttcttcttcaacgcctcaagcagctcggccggcggctgctgtcggtatccctgagggttgttccgcgtccagcgccagaggtcctcacacgcctgttcgagcgtccgctcggccttccagcccagctccttgttcgcccgcgtagggttcgacgtcaggtccagcacgtcacccggacggcgaggagcaacctcgtatggcaggtcacggcccaccgcggccgagaaggcgcggatcatctcgtagacagtgctgccacggccagtacccaggttccaggcgcgaacaccaggcttgttcgcacgcaggtagttgagcgctagcaggtggccgttggccagatccaggatgtggatgtagtcacggatggcagtgccatcgcgagaggcgtagtctagacgttcaggttagcctgagattgcgtaacgccagagaggaaaaccaaactcaccatcgccgaaaacaaggagcttctccctctttccggtcgcgacctgagccagaaggggcagcaggttgtagggaacaccctgagggtcttcacccatgatgccgctggggtgggcgcccgcagggttgaagtaacgcagcagggctccgttccacttctcggcctcatcagcctttccggccttggtgaggttgttgcgctgcgcgttgatgaagtccgtgatggccgtctcaacaacgaacttggtgtttccgtaggggttcgtggggcccagggggcactcctcggggatggggatcatgttcgagaagcgcgtcgcgtcaccatagacagtggcagagctggagaagacaatgttggtgacattgtggcgctgcatagcgcggagcaggttgatcgagccgtagacgttgacatggtagtagtcgagcggcctctcgccggactcgccgacagcctagcagatctccgttcagcaccaaaaacccaaacacacagccccagaattaggttataggcagaaatggacataccttgagggcagcaaagtgaatgacgctgtcaatgtccgggtgcgtctcaaacaccttgtcgagcgaagcttcgtcggtgatatcgatctgggcgaactcgggcctcttcccggagatcaattcgatgcggttgatgacctctgcggaggaattgtacaggttgtcggcaatgacaaccttgtagccagcttcgagcagggccagggccgtgaaggacccgatgtagcccgttcctcttcacgtcctgtcagtgcattgctggaggcagcggcggggagatgcgacgactcttacccggtgacaagaactgaaccagcagacattgtttcaatgaggtgataggacagaatatacagaagtcaccgcaatgggtgtgctgtacttgtcggggagcaggagaggttgctggtgttggccagctgggcaataataataatacgatgactttggccctgctggcggggcagccacagcgagacagcggggaggtcaggggagagggcacgggatggcgcaggcgctagggcgaggaggggcgcacagcggggactgcagcagcacaagcagaggcaccagggcaaggcaacgaacggcaaagagaataataataataataataatcagggtgatacggccagtcccgttgcttattcctttgagtgcccacgcaggacgcggcgctagcctttaacgaatttcacggtcaattttttttggatgtatagactgcctagggcaccagtttcggaaggaaaaagcggacacgtcagggtcgggcgtctgtggctctgtattcaaatagcagggggtgcagaatctaggaggctgggatttctagatggagaggcgagagaacgaatgccaacagtagatcctgacattcttccctccggcgtcggcttgagtttttatgcttttcttgtagatcgatatattgtgaaggtatatctagaagaggaaacagggctacaagggactactctcttgatgtacaaggaatgaatcagaatgataatgactggattgcttaggattgcttgaggatgagcgcgaagtctttgcgaatagagtggacaaaccaacctgcattcggggcggttgggtttttatttagataaccggcgggttttcggagggttgggttaccgaagcgcagagggagtatcgggcaacaatgcattctgcccaggtccaggtcacaggtcatctggccacagctcagacctcaccagacaccgctagttacccgatgatcacttatatagtcaatgaattgaccaatcaaaaccctaaactctttatatagaaatacccttagagatctatgaaagactttaggcggaggatgcggcgatcaaaggacttctcagtgagaacgacggatggttaggaagtggtcagggagaaataacatgctactgtaatacataattattacaagcacagcgttgaactacgtccgagtaattgtgggtcataccaagcaatacgcttcccgatgatactgtatcatttgcgggaaaccagagcccgcaagctgaggctgattcagcgctctctcgacgatgactgagagattgattcaaatcgacgcgcagcgaaactgtacatgagtatagaatgttcttcattcgctcctccactcaataatgatcgttacattatcggacccaagccattcatccagtcttatcgccctcaaacccttctttttctttcccatgctcaatattctcgtcgtatgccacatctggatggaggaaatctaattcttattgctgtcaggcccgggcccgtgacatgcatatgtgatacactcaagccaaggcacgacccactgaagttccatgcaagaaacataaaagaagcagacgttagtttctaagactataccatgattaacattacatctaaatatcagaatggggaagaccggccggcagcggtagtgtagtggtaagcacaccgcggcggcctccaacggcgaaagggtgacctgcccacccctagcatggagatcgtgggttccattcccaccacaggcgcatcatttaccacagaaatgggcttatcttcctagttttcgcgcacggcgcggtctctggtttgtgtctgagtgaaagggtgcctcgggcacgctagctctagggaagtgagccatacccgcgtgctagcgcgtaatctagccacgtctgcgtgctggcgcataatccagcaatgctaaataaagcctaaccccaaatggagtagaaccagttctgcaccgaggaaaagggcatgggaagaccatggtaatggaagctagcagaagccacgtggctatcagatagggaaactggccttatccataatggagctggggtgagccagctcacgatgtatctagacctaggtctcaggaagtggtgaaacgtgtggtccctccttggaggaacctcgtctgtcatagccggaaggctctatatggacgttaaacttgattaaataaataaataaataaataatgggggagacttgcgctgggtcctcacagacgaaggattcacgtacaactagggaatcatgggggagtcaaggttgattctgatttggcctagcggaaactatcccattattcgatcaattttccaagtccaacgtagaatgaaccaaactgaataaaggaattgcttgattgtaagagcatgaattgctagccagtgtccggacggtgttcaatcaaggtctactcgatatctttagaaggttggcgacactgatgggtgagaggggaaagctcagagatatccttatatctgtaatattcaaatgtatgtaggatatgtagtaatcaattcagtctgcaaggagaagtgtctgtgacgatacctcatcgtcctctgtggagagattgtccgatttacaactgcataatcctttctatcaccgatgaatgagtgtggttatatagacattccggctgtccctgattccaagtcattgccacctaatcttcaatctcctgccactatctcactattgctgcctaatcttcattcttattatatatatttatgctcctaacacccttcgtctgagccatgtactcgtcgagcttcgggagaaattccttcatgaaaactccgtcaaacatctcctcgatcttatctaccttctctccgctctcgtcaaaccatacaaagacagcatgctcgttgttgtatggcccgagcggcgtgtccgccttcgtgatggcatagataacggccttgccctgcgccgcgtcgtgcacaacgttgtggactgtaagctgctcgttctcaagtcagaatttgtctgtatttcaagacggagccctgatgcccacttacctggaagtttgtcaagactgacatgagaacggggaatagtttctcggtgtgcgcgcgcgtgcggaccggcaccgcagaactgaaaggcagtgtagtttgtgtgcaatcgttggaccagctagcgaggaagccgtcggccgtccatccgctccaacccttgatgaacttctcgagcgttgccgcttggacttcagccggtgcgggcatggtaacgttggcctgtagggcgtgattgaatgagagatgaacgggtttcaatgtctactgttatacagatgcccgggagagtcttcccttttcttgaatactttattgcaagtctgggagattgaaaacacgctcttctcagttcttctcggaatatcacaccatgtggaacatttttcggtgtctcgcacagggaccggacatcggcagatactgcagcagttgccgcatctggtaaaccccgatgagaaccgcaattcattggattccgacgctttagtccatccaattacaaattgcccgagataagctggccctggaatccctattgatcctctggatgtccagcgggatcaacatgcacatgacgataattttgaatggcttgcttgtcactatcgttgcttgacaatgttaccggtcgacaatggagggccaaaggtactcgcgacctggcgtgctatttccgctactccgtacaagtgttcatcggaagatgtcccaacatcctcactgaaaacataagtcaatggagcaggcaccaaaatttcgttcaaacactcaactgaaaagcagctggactaaggtcgttggaaatccatgccattgtctacagcattgcagggaacccgagagcagatgggcgaatgcgctcttcggcgcatctggacgacggaatggacggccgaatgtcgcttgcccagggcaacggcggttgcgtttgactggaagcggacatccaagggtttattacagctaaacggcttcacagaagtacaataatagatgtagtcgcataactattactactgtactgctctgctctgtagatttacatagctagtgacagtatactgatatattgctcaacgcctggtggccaagatgatcttggccggccagtgtcccttgaccggctggtccttgatgacgtcctccatctcgcgccacaactccgcaaaggcagcggtgtcttctctgacgaacgggaacgatgcgacgtgctctcggacgccctccaggtccgtcacgaaactccagccctcctccctctcgaacacctcgacatcgttcgccccggtgtgcagaggctcggtcacctggatgtctggtggcaagggtgccgttattcctcctttctccatgttcagatgaatgcgctgcgcacccggcaggaacagcgcctcatccagtggcgcgacgttgtacggaccttgtgtcctggccattaccgctatcagtttctctggatcatcggtcttttccaacagcgcgcgcccgccggactggtggatccgggtgtagatgtcttgcacccgctcatcctcgaagcaagcagctccgaaggcggcacatgcaaatgttccgccaggcctcaactgtttcgcaatgacttccatggccactttctggtcgcagaaatgcatcacgttggtagcaaagaccatgtctacgctgccatcgggaatatcgtcaccctcctccacgcgggcggcgcggtaactgaatccatcggtgcctagtcgatctttggcgagggcgacattatcaggtgcgatatccgaaattatgacatgctggaacttcgaccgtagcttgtcagcgtaggggccgtttccggcccctacgtcgtggacggtgccgaatttgccatggtgctcctggtggtagcggaagagccgctcgaagaagacgtccggaacagacggccggcccttgagatagttgttccagaacgcctcgtccttggcgaagagtttgtccttggagtcaaagggggccggagtggtcatcttgctagccgtggaggtgttcttggtagagctgaatcgtggcaataccctctcgtttcctattgtacagcgcgatatatagacccattacccgccgtgggtggcatcacacctgagctcaattctgtgcagcagtccgtaggctaagcaagcaaaaggctgcttccgctcggatgtcgggaagcgaagccaacacttcttcatgtccgagatcctctccatggagcgctagatctgtcgggctatcacgcctcgtgcgctctgatcctgacaaacataacgtgtaacgacttttgccaatttcacaagcgtgaagtgtcatgtgtttaaagttcgctgtcggaactcgggccaaagaagggctcggtccatttattacagagagggcagatgaacaacatcctagcaacggttatgagattatcggtaagataaatggatagaatcgggcaactaaggcccgaatacgagggagatttgcggactagacgacttttccagattcccgagctttcggtctaagtcatatatgccttgcgcttctcatctcatcggcttaggtattccaccgtgaacggcatcttactgtttcaagaactttgaacaagcataagccagtgttccgcagatcaacacttttgtttctagcgaggttccgagttgaaaatgggagagtatcttgtcgacggggacaaagatgaattcgatccagataagtggacgtcgagtagcccaaacgagctcccacaacgttgcccggagacgcacctcaatgtgctggtcgtcggtggaggcccatccggactgatgacggcgctggagtgctggaggagggggcacaatgttgtggggatcctagagaggaggccaggcccggtctatgctggttcgtttgttgacccgatccccatggactcgaccggatggacaactgacgatagtcttcggaggtttgcaggagacattatcgtcatagggccttcggctataggcacgatgcgctactggccggatatgtgccgtgaactcgaagcagaccgaaccgacagcgtgatgtactatcggtggcataccggcgagctcatcctgggcccaacgtcgctctggtacaacgaccctgagtacctggccaaacgggaaggcctcccattcgcggcgccccatcaggttcgcaagaagttctaccgaatgctgctgcgccaggtggccagggtcggcctcagagtcgaatacggccagcgcgtcgagaggtacttcgaggacgaggcggctggggtgggtggggtggtcacgcagaatggcacgatacgcgtcgcgcacattgttgtggcggccgatgccttgaggacgccctccgagctgctcattgccggggagcacatgcccgctcggtcgagcggcatgtccgtctaccgtgcggcgctcccgactgagttggccatgcgtgacgaggcgttcaggaagcggtttggcgacgttgtggccaagggaacctcgcatcatgagttctggataggacctggcatgcaccttggcctctacgtctcgggggaatttgtggcctggggactcacgccgcgcgaccgcttcctgcagccgggcggggaggagccgattgagtcctgggacccggacgtcgaccccgaggaagttgccaaggtgctccgccgcatcccggactgggatcccgccatcgaaggtctggtgcgcgccactccgaagggcgcggtggtgcactggccgctgctctggcgcaacctccgccgggagtggacgtccaaaggtgggcgggtcgtgcaggtgggtgatgcagcgcacagcactataccggcctcggtcagcggcggtacgctggccatcgaggacgccgtgacgctggcagcatgcttgcagctcgcatgttccggcgggccaagcggtggacccttgggagctcggatctacaatctgctccgatacgagcgtgtcagctgtgtgcaaaagttgtcctttgtgaactcggagagcctgggtgccgggaataaggaggaagtgaagaaggaccctgagaaggtccgtgtccggtttccgaagtggttatttcagcacgatccagaggcctatgtgtatgagaagtacgggcaggcgtttgcgcatctggtgttgggcgccgaattccagaataccaactttcctccgggccacaagtttaggcagtggacaatcgaggagatccatgaggctgttcaggccgggaagagcgttgttgatttcttggatggagattggtcgtaggcttccgtctcccatagattacaggtcgagtctgtagagaaaacagagaattctagacactatcaccctctatgggaaaacggacattcacgagcgtcctcttcacctgtttgtcacatcctctctgctccctccgctggtccgtcatcgtcttgcagcggagtcacactacggatccgagcagctgcgtcttcagcctgcttcctcgtcccccttcttcaacacgttctggagcagacgaactagcaggaggaggttgagctacgtagattgttctctgcataagtaactagcgggcgtaagatacgagacatggtaatcgtatattaatgttctaactgtcagagatgtcgatgaagagaagtctgatttgggtagaagatgccaagtggcacgtctatataataggtgccgaagctgactaagccggaaaggggcaaaccgaaatctccgacagttcttttgtacgctcataccacaatgtctatattatatcctggcctttaatcttaaaatcagattatatataggtataactacttgtaagagaaatataaggttaatattatatatattgctttttagatacctatttttaattttacataaaaattacactgtattttatattattccagtaaataatagagtagactacttctgattaatgctgtatgctgtaaatactttataattatagtatataaaatatctctttaatatctttaaagcttgttgaggtatgagcgtacaaaaaaaacgcattttgtatggtattctagtgatcggagcaaccgggtgatcgaaacagccgggaaatacgttaatagattagtaattagctaattctatttagtttattaaaatctattataatattttgtaatagaaattaatatagcttttaaaaaaattatttaatattaaaatataataattataagtttttaatttatttttattaaattataaagaaaggtttttatttatatattttataataaactatattagaaattttataacttttaaatataaaataatatattaattttaataatatatattaaaacaatatttatattaatttaaaaacccaaaataagactttaaaaaactatttttataatattattatgataagttataaactcaggtataattaattaaatttttaaatagaatttataatttattaattttataatatttagtatattaatatttataattttatatttcttaattaaaataagtctaatatataataaagctttctataaatattatatagataatatcctatattattttataattcaagaaataaaaactatatattatcataatttatttatttattctttaatttttatataaatattaaataaaaaatttttaaatattattaatataaagagctagacttataaaaatagttattaattaattaatcctctataattctttatatataatttattattatataattacagattttaattatagttaataatgtacttttttaaaaaataacagacttaaaaaaaaatgtttaactaaaatatagttaaaaaatataaataaaacagatataataaaagttttaaatatacccttttattattttaataaaatagtaaaatgaatagttaattattaatctactaattaagagattatataataaaagaactatataattaaagcctaaaataagaataaaaaatattaatattaatataaatgagttaatagacttttataattttttagcaaatatctataattatacaataatatattatatagtaatttacagaaaatactattaaataactatttatataacaagggtataaaagtttttagctaatactatttttactttataattatttttataataaataataaaaataattataatttaatattttttaaaatatataaattatataattcttatgagtaactttaaaaaaattttttattcttaatattaggacttttatagctaggtcaaacttaggttaatttttaaaaactattaaaaataaatcatataatctttattattttataagagatatataatatattatccttattaaaaatctaaaaatagataaattttaatataatctaagatacttttatacagctatacctaaagttaaattttaaccttatattatttaataatatatgattacttgaatattttattagtttttattatttatgaatttccctatataaaaatattaatatgtatattatttaaggttaaaattagctatttttaataataaaaattgtattagttaaaaacttttatacccctactatatagaaatctactagcttattaatatgaattatttaacaatagtatttttattaatataatactaattatatatttagaatatacctattttattttagtaatccttttagcttataatataatattttttaaactaaaatagtatgaatataaatatatactaagtatagtctaaatcttttttattaataactatatatttataatgctagatatattttttataaaagtattaaaaggttaaaaggtaatattaaaaaaataaaaattaaagaaccaaaggtaaaaaccaaaaataaataatattattaaatactctttagtataatgtaataattaatatttacaaggtcttgtcacagcgcactagtacatacactgctcctgacctttctatatcaacctatagtaactaccttccaccctatatatatataatgccctaaagctaatattacctatataataaaaaaataataatatttatttatacctttcctttctttactactatatatagcttattacctttattatataaccttactttctctttataataccatattgaccctttaggttatatcttttattaacttatttacctctaataaatctaagttagtattaacgttagtattagataaaattattattatccctattaaagagtctctaaagcctcttatttaggtagttaataatctttattattcaaattatgaaaggctacttatatatataatttgctttatataatagtttagagtttattatctatttttattatagttactagttattaattagcttataaatctaacttaatagtagctataaaaaatactatagctatagatatagaagactaggaattatttaattaggatcttcttatataaggtactagagtcattaatggaatagaaatattaatcttagagtaaagggactaggaggtaatataatcttattaaaaatattggctaaaggcaaataagctaggtaagatactaatatatatataaggcttaagaaccattaagactataatagctaattattaaactttactattaagaaaaatatattaattaaaggactatagttcttactagtacttagttctagggaatatataagaaatataaaaaatattaaaatataaaatgctttaaattataatattagaagactataatgaataataaagatataattaatattagtttatattaagattatagatataaagctaataaaggttaagtagatattaattattaagggaactatcttaaaatccttattataagggttacctaatttactatatcctaataaaattagcttttattattagagaaaaaagttatataatcttacctttataagttattagccctaataaataactagatataaaggtcctttaaggagctcctttatagttaaggtacccttataaaagatacaggtatttaataagaattaattattatattaattatagaaattaatcttaatattaatctttttaatataataatacctttaattacctaatagaattaatattaggtaatagctttaatagagatattaatattatagaggctaatagtaggatctttaataataaagagctattaagaatataaaaaaatataattataaagggtaataaaagatataataaataaataaagtacttaatttattaggaagaataaagcttaaagaattgtaaagggagttagagggatatatattttcattataagggtagagttatagttaaattatccttttaaatagttgacaactttaggaaatataatattagtaatttcttctttaatattacccttaaataggaatatagagaggttttaaatatctataatctaagataaagtaatataaagttagctctaactaaagactagtaattataagtctatattaatatattttagtaattaacctcaagatttgttaatagttattacaaaaactaattaaattaaggttaaaatgaaataaagctctcttttattattataaaaccaggtctaataaataaggtaatatgccttattaaacttattactattaatttatattttaaggtaatatataaaggctttttataattattaaataggtcctataaagtctataatttaggtagatcttagtaatataataggggtataaatttttaattataagactaatatttttaattataagactaataagggtaaagaactataattaatactctcgaagaccttagtaccttattctttatattaattgttattaagattatatttatcttgggcataggaaataattatcttattaacctaaattagaaattactcctattaagctattatataagtagatctttttaataaaattgtaaaaccttaaggtatatataatttataggagtagaattcttttttaaaactaaaataagatatctctttaagctaactactaaagatataattctcttttaaaggatcttacctaaattttattattttttaaatgtaaataatttctaggtaaggctataaactaagagcatttattaaaaattatttttaaaaataattaagagacttttaaaaggtttagaattaataaaaagatttaaatataggtcctataaaggtatcgttaataatattaaaagtataatagtaagttataggggtcttatcttaaataaataaatagatttattagagaagcttagctaattcttatataagatattataaatagaagatttagtaatattaataggaatcttaagttatttataggctattctactcttaaagagaaataaagttattatattaatagttattatataaagtatgatcttttttttagattttaattaattatataatattcagtaaaaaaaaagttttctttatacccttaaggctataaaagaagaattatattattataaggctttcctatatttattaaagaatatagttatattataggctatgtattaattataattaaataaagcctcttattaagtagctaactctattaaagtagttatactagttcctaagtaatatagggattagtatctagatcttaataagcctaattattaataattaaaaaaggttaaagtctttaaattaatagtctttattttataaaactttctaaataaagtataagccatagtctaagtctaggtattctaagttaggaggatactagagactataatcttaaattatctaagttaatttattataaatattattataaaactagtttaaataatataggtattaataagactattatatatagtagagactaatagctattataaatactattttatttatattttataggcttctttaaagtatagcttatttatttttttaaatagtaatcccttaagtataataagcgtcttaaaaggtattataaatagtactattcattatataaagactttaaaattagagggactaggtataataataaaaaggtattaaacttctccctaaaataatataatagtatagatataattaatctagtagaaaggtttttattaaaggaattattacctcttaaagacttaatataattaaatattaaaggctaataaagctagagagataaagagaggacttactcatatattttatttaaaataagtaagaaagtcttaatagagatattttaatatatctagatttaatatataatatttaaaaaaccttataaaaggtatcttctattaatagaggtgttctgcaactgcgttcttccgaagaatgagacctattttggaaggtcggtgggtcctagagtttgcaccggttttttagtctctttttatatcctaattgaaaggggattctttaagaacttctgaataagtttgttctgaagaatttgaacagaagaagaactaaataggaaagtatgcttatataatataagaaaaagaaaatacttttttttaataatacgctattaattataatataaataagaaattctggaggtagctaaaagagcctaaggataatataaatccttttttaaatttattataggcaaaggggaaggtaaaaaaggagggaagtatttatattttcttagttaagtaaattagggcttttacataaaaaccctagattaagtaagcctcttagattatataataacggtcttaatgacctatacctatttaggccaatggactgaaacttttttcactcttctaaagaatttgcagaacacatctaattaatagcctaaagaatattatttataataatatctatttaataggttataagatacttattaaggagataaactactaaaggcttaattaaaggattatttttataaatcttcaaccctataatttactaggtatattttatagacctaatataataattattaatatactattagatcttattaattttagtataaaactctatagttatataattaagaccttaatatatatatttatagatatactttataaaatagatactattatagactttaatgttaatattaatataggcctagtatttctaatataaaaataggttataaggtactacctatttattcttaataattatagtctccctaaacctagagggataaaggatcttaatatagatactagatacctaatattaatactttagatatatatctatatggtgaagtggatggagtcagccagtcaccaatctgctggttgagaagtcatgtgacaaggaagtcatgtagttatagcctgaggcaggaatagaaggaagaataagaatattttttaatggatgccaagactagtataaataggctattaggtttttatatagatagttttaattaacctttttaactccttgtatataacatatactatataaccatagatttttactaggttataagcttagactggctctatagttatagataagtattttttcttactaatgctaacttaatactataattataagtagtcaaaggctttgctgatttagataaatataaagagactactaaaccctaaactgatattatagagatatcagagaaacttttacctaaaatagtagctaatcataacttagattagatataaatctcctagctaccctattttctcctcctagctactaagtttttacttataaagactactaaagactaaggcataaatattgcctacctacctattaaaatattatcctaaatataaacttattattacctataataataactactcgaactagctctcctatattattttttaaacctagattactttccttttatttatacctatctagatacttacagaggagtcaagctttttagatccaatacagaggatactaaatattaccctttatctccttctttagatatagttactaacttaatactattaatactactacctaataatttatttagttttaaaatctaaatgcctcctaggatgatataataaaacctagatataagtaacttagaattagcgtattcctactcctctaacttaaaccctttaatttaaattaacctaagctaataaagattaataataaaagtaataatattttataagtgcatataaggactggcctttatactaatccttaaaatataactagataaagtagaagagagatatatctaactacctaaagattaataaaaatagcaatctcttttataaatatactaaagtactaactagagattaaggagagactaaaaaagagtttataataagagagaaagaatagaaggagaaatagagataagcctatattatataatataaagctgtctaagcctaaatataagagatactattaatagggttaaaatagtaaagatctttaataagctagaaatttactactacctataaagatataattatttttaagccttaatataggagctaaaacggcttatactaaataattataaataattataaagatattatagagttactaagtaaattaggagaatttatataagctataaaagatttacctataatatattaaaggcctactaggttaatacgtttcttaatagactaagaccagattacatattctttaagatagccctattctagaatagaactctgtaggataagaacaaatatttagatacttccttagccttaactactactttaagcttaattttaaccattaatacctactttaaacttaataaggcttacctttaataaggttattactatagttagtatagaagaaagttaatttaaaatataaattataataaaatatattataccttctttatttaagggaaaggctaagattaaagggtcaactataattattccttattataattactattaatacttcttctatattaaaaataactattaggagctatatcctaagttaaagaaggatataactaaaaaaggagaccagaaatacttaaaaagaaattaagctaaaataaacctaattaaactagagttaaaggcaacctttatatagtagcttccttaaagccttataataaatttattaatacctttataattaatactaaggctacttaatatatctgttataaactagaatactttaactactctaccttaaggccctatataaataaagaccttataagacttaaggaattctatctaaagctagtttagaagggtataatatagatccttatattctagagccctaaaatatcctctactacctagatactagtataaaccttatcttagtattataaattatagaaagggagtagagatctaggctctaagggattagatagagattctgctatttaattaattactctagtttactatactcttctataataggatatatctcctagagctctaggaagtactaattaaacttatattacttagctatataattaagaacctaaagttataaatctagtactactaacttaaatacctaaaggaggcgagcattaagtagttatagaagatattaactagtattaatctactactagatagttacctataccttccccaatattaaaaggtatatacgagaggatccctatagatataaaattaaggtatttatccccttaaatttatttatattaatatttatagtctttttctagttaagggctataatagttcttaatattaagttatcttccttaataattttagtaggcagaagttatacctattaaagagaaaagtaatctctttgagttctaatatttcctaatatataataaatgccctaaactaagtctacctaaatagtattagggagaataatagtaaaaaatttagattaaggtattattctaaaaccctttgcccctaattagtataaataaaatagtatagtagagtctcttagttaaattattatagataaactctaccttataatcattaatactaggcttaagctaaagtaatagctagaaatactttatactattacttatttatataactagtccctaagcttagttattagtaagtccctatataaggcttaatataataagaaactagacttagcttacctctatactattagctatatagtatactccctaaaagtaaagaggaaatataggaagcttattaatttaaaggtatttgctataagcttcttaaatataagggggactatattatctctttacccttaataataggattatctaatccttaaatatttatttttataaggaatagtcttatatactagacctagatattcttaaacccctttataaataactataggctattattagaggggaggattatctaattaataaaacgtttaagatttatataaggcctaaatatttctcttctatagggaaagctattagactagctaatagtacctataagtagtctaaaggataattactttaatactacctagagagataataatcctaataataataattctacaaaagataatagctttataaaagatatactagagatattacctaatataatattaggaaaacctattaataatatttccttattacctaaccctttaaataagctagtactcaaaataatatacttaattagtaatttaagaataatcttataacccctttactagttcttagctataatagctaaactagctaaattatttaaacctaagacttttaaagaaatataagaggacctaaactaagagaagtagttaaaagtaataaaagaggagcttaaattaccactaaaaaaataaacctagaccctagttaagctacctctaaggacaaaagtactaaggggaaaataggtataagataaagtaagcgcctaaataaggaaatcctaaggtttaaagctagataaatagttaggggctttaaataaaaaaaggaattaattataataagacctttatattagttattaagctaataagctataaggctctatttattattatagctatactagattaggaaattaagtagatagatattaaaatagcctttttatataataatattaataatacggtctatattaagtaactaataggcctaaaaaataatattagttggatctataagtttaataaggctctatatagactaaagtaattattaaggatttaatactttatattaagtaacttcctaaaaatataaggctttaaactaatcttaatagacttaggtatcttttactataatttaatatatattactatttatattaataacccactaatctttagactattaattatagagatttagagagtgaagaaggcccttagtaagtatttcaatataactaacctaagtctatataactactacttagggatatctattatatataatagaaagaactatattatctaactctcatagtagggatatattaagaaagtactctaaatttagaatataggattataaactagttattatactaatagatctaaatataaagctaaaagatataaagccagataaaataaataatcctagactaatattatagtatacttatagtatctatactaaattactttatagctaagcctaatataacctatcttagggcagctaaataagtcctctattaccttaagggtacccttaattttacttttatttataaaggggagctatatccactttatactaactaggtagaggaggtccctatataataaatctatattaggttatgtctttaacttaggaagtagtataattagctagttattaaaatagtaatcctttatagtactattatcctataaaatagaatatataaataaaatataggtagctaaggaggccatttagctctaatatttattaggatattttaagtaggagcctaaaggtatagttattatctatatagaccctaaccttaattcctataagcttactcctaagctaataactctttattataataattagggggcaataatactaataatctaatattctatataagaataaaatatattatagtctaatactattttatataagagaagtaggaataaggccttattaatatttgctttgtccctatagaaaaatagattatagatatcctaataaagatactactaaaagactattttatcaagctttagactatacttagattaaaataagaacagcatctttagcctatccttacttacctttactactagctatatatatatatatatatatattaatataatatctactagagccctatactatacccttttctataatattaaccagtaaatgccttagataaactataaatagtaatcatatttagatagtaatataaccctccttttatatctttgactaaattagatatatcccttaggatatcttactcttatagctctctcttcttacccccttactaacctagagacccttatacctaagctttctaattttctataatagtttaggggactaaacctattatatatctatctaaacctaatatcctttctaaataaatacttaaagactagttagatatctatactgctagattataatagttataactatttctctatattataggctatacctaaataataataagatacttagcttatactttttagtatatagatctaattatataggagatagggaataaaaagattatatctaatattactaggctactactctaattaagtcttagaagggaggatattacctagttatctaggactataatctatacctagtaactattaatagtagggaggagtaagtaaagaatattatccttttaatatagtagaagtttattaaataaatatatagaaaaagaaggtagttaggaggactatagtataattaagatattatcttaaatactctctatcttagatctaagagatagtactactaggtaatatacctttttaaatagtaggagatctaaggataaagggggtatatacttagctaagaggtaattatagattaagtaagagtataataatagaggatagaggtatagacttagtaggagtttagaaatagtatcttactaactatctaagtaagagtagtaaagcagatagaattagctagttactaatctactagttaagaagttatataataaggaagttatattatagttatagcctaaggtaggaatagaaggaagaatatttttccaataaatgctaagactaatatataaataggccagtaggtttctatatagatagttttctaatcaaccttttcaactccttgtatgcaatatataccacacaaccatagattttcaccactatatagattaaggtctctttaataaagggcttaaggaattatttagaattatattatgatagctattataatcctttatataaggagtattaggattgtagactataagattaatatattatctagttaataataatattatatagctattagctacctagactattaaagtctaatattttagtatagacaactttattaatcttcttaataatattatagtaaagactaccttaaaataataaataggtataaggtatattatacttttagtattaataatagaaatataacctattacttaaatcctttattaatataatagcctaaatattatttattagcctatttatttatatagattagggtaaggcctaatataaatagagctaaatatcttaataacctagttatccttatttattaagaattttgaataaaggctactaacttacaatttcttatctttaaaaataggttataaatttagctactaataggattagagataagatataattagggtagttaaagattaataataaatccctaagcttaagggtctcctttataagttatttattttatagatatccttagtaaggagattctataaatatatttactaaattaatttatccttagcctatatatatatctataggctactagatagatgactagattattaatagagtatttatatattttaatattaaaatactatctattagttatagagtttattatatagtaatatcctagcgtatacttaattatacctttttaaccttaataaggctctaagtttagatttaaaattactcttccctttaataggtaaagtctttaatataggatcttaatctattcctatataaataaaatccctgttattaaatattcttttaggcttataataatattagattctaaggtttttataattaactaagttactattattataatatatagtaaactaataaatatttagtctacctatagaggtaaccctaatgtctatttaccctaactttaatagcttttaataataagtaaataactaaaaagctaaaggttttaaagtaatattataggttatctagactaattagttataagagatttagtaggtataataataatagataaaatatttatcttaagagaggtcttttttatagttattatactttttaataaaaggaagctattagaataaggactctattaagaagtataataattaacatagcatatatatattattaaaaagatagattaagctagctatattctttataaggctttaaagtaataatagggtaatttatatctagatcttaataggtcatataatagtaggtatactaatactaaaaggctaagataggttaactgtaatctttatatagcttagaagctagagtagtattataggaatctttattttaataagctatataatagctagtgtattaagaataatataaagaaataaatataaagtaattataattcttatagagctataaggctagagaggcttattgaaacttattataatagtaagatatataatattatatcctataatattataggatactacaaatatttctaaaaagtagggataggagagtaataatctaaatataattaagttataaaaggcctatattaagtactattatatataaaatataacttattctaaggctaaaaagggagtagctaactataagagtaatagatactattaatagcagaacttattaggtaacctatattatagactaaaataactataattatatagaaaaggctaaagagataaaggatatatattaggtttaataagaaaggatatagaaaagtaaaaagcaagatatttagagagaaaaagaaagaaactaaggagctttaaagagatatatatctttagactaataaatataattattactaaaacttaaaattaataggaaaagaaacctaaaaataagactactatattatataaagagaaagaaggatttataggaaaatataattaattagtattaaattattaactatacttatcttaaagagaaaaaataattataaatagctaagttattacctttatactaaattaagataggactctataatatattataacttctatatatataattattaatagagaagggaaataaaagagctaattatatctatcctaaagaagaggagtaataaaataatatatagtaggttaatggagaaaaaaattaaattaaggaactaaataaacttactatagcttaagctactagtaaaagtgctactatattattatataagggatttattataagagagttattaaagggatttagaggacttaataatactattaataaattaggttaatacctcttatattaggtaggttactatatatcttctaaaaataataaagaaagaacttccaagagaactagaaaggtatgtatagctatataaaaaagtatatgtaaagatataggtaatattagatagagaataataaatataaaaataataggggaaggtaaaggtaagaataataaagtaataaataaagtaagagggaaaatagtaaaactaagaagactcaaagtaaataaagatttatagaaaaatatttaagtactttaaatatagaaataatagaaaaaggagatattaactaaaaatcaaaaactatataaatacttataactaataattatagctcctactctatatagttactcctatatattatagctacctatagatagtataatagattaattagaacacaaataaatacaagtaaatatatagtatatagtatatacatatatttgctgcaaaatatacatagcttagattaatatttcttaaaaattaatttacccagggttaatattaataactagctaaaattaatttataattttattattttataatttatcaaatatttcttattaaaaattatataaagcataatatattaattaattctaaaataataattatattaaaaatttaagatatattgttttattaaaatatttatctatcttattagcttctatatataaaatagaatatataaagaaatttaaaaatttagaaatacctttaaaatattattctaattccttaataattatctatattaccctaaagtatatacctaattatctaagtatatacttaaaatattatctatttaggtaagaatatctttatttataatataaataaacttattattacttttacctttataacctttataatgacttttattcctatttaaactactcttaatatatatatctaacatatttttaatagatatatatccttctttaaaaagtagctaggactatatttagctagtatcttatttatagttgttatattagtactatgactccttttaataatattttagtatcttttattattatattagctttatatatacttagattatatataaacttactactattagtatttaagctaaaactagataaggttattattataataagtattaaggaaagttgacttaagaaaataaattaaaaacttattaggcttttttattaaaaaagctaaaattaaaaggttaactataattattctttgttataattattattaatagtttttttatactaagaataactattaagaattatatctaaagctaaaaaaaagatataataaaaaaagggattataaatatttaaaaagaaattaggctaaaataaatctaattaaattagaattaaaagtaatttttataagaatatttttagctttataataattttataaatatttttataattaatattaaggctgtataatatatttattataatcgattgattgattatttcctacttgggtctgtcagcctattagctgattgccagcaggttacattaggtagtgagcctcctgctaatctgtaaaaatgctttaactatctcaaactatatataagcaaggaaaattaaataactaaatagatgcttatagagtttattatcttataagcagggcctataggctaaagagcatcataactatctaagaaaatctagtaaatagagtataagagagagagaaaactaatctaaattatagtaaataaaggaaaaaaagtaaggattaactagggtatcttatttaggcttaggggtagtactttattattatcttctactacttatttactagggatataatagaataattatagctctctagttaattatagtgtaagggtaagtaggtagttaaaaattaagtataagggttactcctactcttttttatagttatttaatatagctctaaattggccaaggagctatatctatattataaagatagctactttataggctaatataggttagcttaagatctattaataatctatgactctttaagacttctatagtattaactcccttagattaatatagattaggtacttaataagtatatcttaggtataagtatataataatctaggtcttaggggtagctgtttctactataatagtaagtactataactatatatctaactactttatttatatttgtagggtattctaataggtaagggcactagttagacctctttataatattaaggaaggcatcttaatttatttagctctaagcaaactttataactagtaacctttttataagtcttaggttaaaggttattttaataagaatatagtctccttctatggccttctaatctatccttactttataggttataaggtactttaagatctatatagtgccctagactaagttaataatggtttagtaaaagttagatctagacttatatttattatatataattctcggtcgacgagctctcacctctacgtggcgactgagactagtagtcagtcttacaaagctgatgaagccaagaggagctcacattctttttctgtgagttttttgggccagaattattgaagttttgacctattctactcttatgaaaaattttcactacctgctgaacacctgcctactatcggtatctgaccccaatatcgagcaattaccaaatcgaacacctagatgtagataaaatatatatatctagagcctacctgcctgcctagggaacaggaaggggcctagggaaggagggttttccatatttaccttctcccctactcggactccccctttgacccgaccgaccgaccccctgcttaccatcgatttccgccccccaaatcgagcgactaccatgtcgaatatccagatatctatatctagagcctacattaggctatattcaacatatagcctctaccatctagccagactaccattcgttgacttgtgatttatttgtttcctaccacctgcttacctgtcttttatttcctacttttccccactaggttgagcttatataagctccctaccaattggcctcaggccatctaccattcagcccctcttagaaggataccacagatgactggactatagcctaaccaatttctgcatgtatttagtcactcgctactaagtcctattgcttaggtaataggcagaccgtgcatagtctctgactgaaaaacgctctctaaaaatggaagaataataataataataatatattttctatacttctagttaaaagagtaataccttaatttactatatataatatatttggccttagttaacgtatttcccggctgtttcgatcacccggttgctccgatcactagaatacccatacaaaatgcgttttttttgtacgctcatatctcaacaagctttaaagatattaaagagatattttatatactataattataaagtatttacagcatgcagcattaatcagaagtagtctactctattatttactggaataatataaaatacagtgtaatttttatgtaaaattaaaaaataggtatctaaaaagcaatatatataatattaaccttatatttctcttacaagtagttatacctatatataatctgttggaaaggacttcatgtatgtagaatttgttggccagccctggcgctgaggggggtgtgttggtgcctgacccatacggcattcaggcagctgccaggtctgaccaatcagctgtcagttaccacgtgaccgccaaaccggccacgcagatttagagccgacctcaacgccggctcctagtcagttcttctttttcttccccagagggagcaataatatattgatcttctatgcctagatagacttcatctatttccccactgagctctcggcagccttacgccgagactctgtaagtatctataggatcctactgtagtccttagcatcaactgggcttataaatttgttaagcgctatcctaagctgcatacaagatataattgaaggattacatactagcgtgcaaagcaggaggatccaagagttataatactatggtttcaagctgtacatgcagctattcaggaacatagcatatatgaagatgacatctagaattttaatgaaactagctttgcaatggggctctgcttaacctctaaggttattactgcagcagaacacagtaaaaggccttatacagtcatctaaggaaactgtgaataggttacaattattaagactgtaagctcaaaggggattcatatactactagtgattatcttgaaagcagcatcttaacaggctgcttagtatcaagaacctacactttccaaagattgctggattgtaactagcaagaatggctggacaacagatgaaataggccttcgctagttaaaagaggtgtttgaaccatattccagacgctatataactggtgcaaagcagttgcttattcttgatggccatagtagctatttaactgcagagtgtgacggatccaattccaggcaatagagcagtttcttatcactaggagcgatctaaattacaagagactaggctgggaggagaggagaagaaggaagggagccaggtcgctagcgaggcgatttatgcaagtattctgccgtacctatacctcaccgcttttctcaccgctcacgtgacgacaggcaagttgaatcgtcacatccaccccccctaattataatataataagtaataaaaaacaaagattactcctactttttaatcattatttaatatagctttaaatgagttaaaaagctatatctatattataaaaatagccattctataaactaatataagctaatttaagatttgttaataatttataaccttttagagcttttataaagttactttaagttaatataaattatttaataaatatatattttattatttatttatttaagctataattataatcttcttaatattaataaagctaaaataattagttaacttgatcttccctacttattaaatatttatataaagactaagctagttagttaataaagtctttataaaaaagagattctttattagttagtattaaaaagattttataaatatgttaaaagtatttttaaaataataagacttatttagttaccttaaattatattaagcttaattataaacttaatataatatataaggtttatataagtttttaatataagtttttcatagtatgtataagagatctaataattttagtatatttatttgttatatatcattttctttattattatattctttagttttatataataattaattataatcttatatactaaatttatataatattttttaaatatatagttattaaaatagttaataacctaattctttttatcttataaaatagttatttttaattaaaataagttatttttaaataataattatatagacctaagttatatagaaatattaaaggctctcggtcgacgagctctcacctctacgtggtgactgagactagtagtcagtcttacaaagctgatgaaactaagaggagctcacattctttttcttgggagttttttgggtccagatttattgaagttttgtacctattctactcttatgaaaaattttacactacctgctgaccacctgcctattatcgatatctgaccccaatatcgagcaattaccaaatataactacttgtaagagaaatataaggttaatattatatatattgcttttttagatacctattttttaatttacataaaattacactgtatttatgttattccagtaaataatagagtagactacttctgattgatgtgtatgctgtaaatactttataagtatagtatataaattatctctttaatatctttaaagcttgttgaggtatgagcgtacaaaaaaacgcatttttgtatgggtattctagtgatcggagcagccgggtgatcgaaacagccgggaaatacgttaataaataatattaggtaaacctattaatattaattataaatctaagatactatattatcttaaaaagaatataatttacctagtttaatatcctatttaattactagaactattaattttttatataaaaaagatacttctaaaaattaatgttatagctattaataatataatattcttttaatattgagaaaaaagatagtaaagtcttcttaactagtttatataagattaatatataataagctaattaaataaaaaagaggcctaaaggacttaaaggatattaggaagtctctaaattaaaaaaataaccctaaaggtatttagactttaaagctaaatagattattaggtagtagtatgaaagctattaagttaataattatattagactaagggacttaatagttagtatttaatatccttaatatttaatctaaagatagttacccctttattagtttttaggtaaatatagataaataggaaataattaaggtctaagaaataaaataatatagtaagttaaagtagttaattataaaaataataatacaaataattataagaacttatttttaaataggtaggactaaatatttatattttaaattagattaagttattaaaaatttagtagcgagatatagaaaataaacaggctaagataatcttataaaaaaggttctaaatctcctatataattagtataaatctttaggacaatatttatctatattaacttaataatatagctaagctttatataataatattgttccttttacgttaagattaatattatcttctatactattctagtaattaagattatattaatattagtatagtatttatttataatatagagctaacttaggcttataacctagtaaaatattaaatgtataaaaggtattaattataagaggttataaaaaattaattagggagctatttataagaattttatatatgaggtcttagtatccctaaagaaacttcattctattcctactaatcatacatattacccttaactgcttagtcagcagcttgatggctggctgacaccattcacttcaccagtagttagctattattaactttatattctaataaagagaccttaattcctacagtataagagaaggtataagctctaaatataatagcctttttttagcttttataggatattattagcttctttagcttatttctattaatttttaagaggtagtaggttatttacagatatcttaaggaaggctactactataggactttccccttctttttttatatagactcttaagaatcctttaagatcttttttaatttatttatctcttctagaggctataatatagaaatataagctatattaataatacctaattctcccttttctaataatataggtctaattagctatttcttataatattaaatatagttatttataatattagtaggaaagtcttataataggatatagtattagccttagtattttataagcctaactaatatataatagtaaagttaaactagcttaagaggttagcttattatatttactattttataaggtattaaagacctataaatattataggtttttacaataaagataattttaaactttaagatactcttaagcttagcttctactcttataaatattatataataataaaaagctccttattataatcttataattatatttaattaaagagtattttaagaaataaatataaaggcaaaagaatctttattattatattattataatatacctcttatagcctatttagataagttagtctctattatagtttcttattttaagttaaataatataaagattagtactaagataaatatctttttaaatatttagaaggcctaatttatatcttttatttatttaaggtttaatatttcttaattaggtctattaagggtattataatcttagaatagtccttaataaaccctataatagaagtttataaaccttaaaaataaataaactcccttaattatatataatacctcctcctctaagattattttaactttctctaggtctatctagatccttttattagttttaataataaatcttaaataataggttaacttagttttaaacttatatttattaatatctagctagagtctattttttaaaggtactataggaccttataaatatattagtattattataagctccctataataaagatatcatttaaatatataaaaataaacttattaaataagttataaaagacctaattaatataatattaaaaagtactaggagtatttattaaactaaaagatataactaattatttaaataaactaaattatatataaaaagtagttagctacttactctttagggtaatttagatcttatagaaggtagtaataatattaagcttaataaattaataaattaataggccttattaattaattttaaaatcttataaattaaaggtaatagataataatccttttttatgatcttattaaaggcttattaataattataataaaattagaggcctttacctgatctcttaatgaaaaggactagagtagtaatattactaggggagttatttatataaataaaacctttattaagacatttaaaagtatcttctataatataaagagttccttttataatatgttatacatatcataaagtagcccttataatagcttaattttattacttttttatccttttttataagctctattttataattaatcctaaggccttataataataagaatatattagccttcttataattgaagatattaaagaatttataataatatttaggtagcttagtctatgggtttatataaattttaaggccttcttaatatctcttatactaatagtaaagatcttaatcttaccctttttttattttaatataatattataagctaagattaagttaagcttctttaaagtcttatttatattagtcttagtatctattagaaaaacattcttctttctattcctaccttaggctctaaccacatgactctatagtcatgtgacctcttaaccagcagattagtgactggctgactccatccacttcaccagtatctaaggctttttttttaaaaaaatatgtcctagtatttatagtaataggctaataattatttcttgatctcttaatcctttactttttaataatacctattataatttataatgaaagtatataaggtctagccttagtactaatccttaaattaaactaaaggtaaataaggtaaaaataagatatattagattatcttaagattaatatagggatcttctctataaaaatataataaccttaattagggagatagaaaaaactaaaaaaactatataataaggataagagaatagaaagagaaacaaaataatattatactataacttaaagttacctaaatctaaatattagagatactattaataaaattaaaattataaaggtaatatttaataagttaaaacttataagctctatagctataattaattctatatattaatataaaaactaaaataacttatattaaataactataaggatattatagactatagtgaataaattaagaggatttaaaataaattataagaataatattaataaagcatataatataaataaaatatactagtaaatactttcctaaatagattagggcctgactttaatatctttaagatagctttattctaaaataaaatattataaaaaaggataagttaaaagagttagatactattatattaactttaaataaaattattattattaataatactaaaaagagttaaattaagaatattaattagaaagatatattaagctttttttattagtagaaaactagagattaaaagattaattatagtagtcccatactataactattatagatgccttttttataataaaaataaatattaagaattatatttaaaactaaaaaaaagatataataaagaagggagactaaatgtaagctaaaagaaactaagtagatataaatatagttaaattaaaaataaagataacttttatagtagctccttctaagatatatatatcttatttagacatttttactattaatattaaaatagcctactatatctactagaaccttaattactttagttatttaactcttaaaagacataataataacctataagaattagagatactagattaaactagatataaaaggtactatatagatcttatataaggttaaaaaataaaagtaatattaggactaaataatattctttactatttaaatattagagtaaacctaatattaataattagtttactctttttaataatattaagcttattctatattaatataagctagttcttaaatctcttttatataatacctactcttaagcctattaatatttttaattttagtcttttaaaaagtaaaactaatttctagttaaataacgtaatccaccaccgagctggtcagtcctcggccaagagttgtagcccaacgcgaccgaaaatcttgaagattattgcaacaaaatctattatattttcctatataaaagaaaaggcactatttattaggacatttaagccgattatggccttctcgattgcaattactgcaccttggtggtctccgtggtcgtcgagatgattcctgcagttgctcatgctcttgagctttttgctgcccttcagcacctgtcaagcttccccctgcttaacctttttataggcctgaagggccaattgaagacgttcctccctagatatatcggccattaggtggtagtggtggtagtaatagtcaaaaactcggtgttggtgttgcggctgaccagctcggtggtggattacgttaatatttatagcctatatttagagttaattaaaaaaatagaatataaataaagttatataaaattaactattaaaaagaatttagattagttgtcttaataataagtaaaaaagtattaggctatatattagtttataatctttatttatctattagtctataggtatctatttataaataattttaattttatattaataactaaaactccttttaaaactaaaataaactatcctttttaatctaagataattatctttaataccctttattattaatagatatactttataaatatactatttttaatactataattatcttataatataagattaaaactatatatttatttagttaatctactattataaatatagtattataactatttatctctaaaaaagagtaaaaatccattaagatatatttttataattaataagtataaataatagatttaggagcctcaaggccctatctctttatataagtttttttataaactaaatagttattaatatagtaattaatatctttttttagatagcgtactagtattatatttatattaattatacgtcttttatttccttaaatatataatcaatatttattaatatatcttattaaggagctatatttatgataaagtctcctatatctaagataactaagtagttatagtaaaataagagtatttttttaagaattatccttctttaaaatttactttctatcttctttaaggattctaatctataattttttaaagaaccttatttataatatataaaggttaattaataaaagtataaattcctataactttattaggagtattttattttttttaactactttagttttaagagtacttatatttaataatcccctttattctagttctactagtttttattttttttattttattaatattaattaatatattctattttctagattagtattaaataaagaaataaaagtaggataaaaactttatttaataggcttataggtatttagttattttactattataaagtattctagggcttaaaagtttattaagatattaaaagggttatcttattatagtctttactttagccctttattctttaagactctaaataatcattaatatttcattataaatctttaactaatttttataaaggctattatttaagaaatataagactagatattaacctctatctatttattataaaaggatacctattattatcttatctaatatatatctatttctagttatataaggtagtctattaataaattaatattaaggctattattaataccttctttaaagtctaaaaagctatcttataatctatagtttattaaaaaggtatattttattaaataagattatataataaataggtaataacgtatttcccggctgtttcgatcacccggttgctccgatcactagaatacccatacaaaatgcgtttttttgtacgctcatatctcaacaagctttaaagatattaaagagatattttatatactataattataaagtatttacagcatgcagcattaatcagaagtagtctactctattatttactggaataatataaaatacagtgtaatttttatgtaaaattaaaaaataggtatctaaaaagcaatatatataatattaaccttatatttctcttacaagtagttatacctatatataatctgattttaaaattaaaggccaggatataatatagacatcgatctctattccagaaagtgtcttttttcgccttttttatggtgtcagtcctcctgagcggatggctggtcgccctgatttgcagcctagccaccatgtatccgcctggctaaaatgattgggtggattttagcacctggagatcattcatttcttaatcacctctcctgaaaccgtggcctctttcagagaaatcatggagcctacaaaatgggagcaaatttgcctcctttactgcgagtccttcagagcttgcgatccctttttggaagctggtacaagtcttataccgcggcaggttttgatgcgatccattttgccgcaagccattcctgtttgttggcgtatctacaacttgttggtgcctgacccataaggcatcggcagctgccaggcctgaccgatcagctgttagttaccacgtgaccgccaaaccggccacgcggctatagagccgaccgcaacgccggctcctggtcagttcttcttttcttccctagagggagcaataatatattgatcttctatgcctagataggcttcatctattttcccactgagctctcggcagcctgacgccgagacaactgtgtttttgtggtgtttgtcttaaccatattaggttagcgctcctctcccaccaacatagttaagcgcatattgattggaaaatactttggcctgcgagagcacgcacacaaccagggcgcttatgtcacagtcctggagccaacaattgatgtcatgtgattacgcaggccagacttgattaagtagtggctgcctataagcagtcctcaggtcgctgaagagtcgaagcatccagatccctaaagtaagtccctagttccgtgatccgcaacattatccttcccaccgatcgaatatcggtctgatcatccccctcatatacgttgaaatagctggaagttactttagtattatcttgcgcaaaggcaacaaattgatagtcagcttgcaggtacactagtttaggcgcttaaccacagctatccaaccaagaagcgtcatccttcccgcctcagaccggctggctgtgcagggtcgcaaaagcggttgatgtgggcaacctcgccgatcgccctgggggatcactcgccctgggggatcattcgtaagtcttgcgtaggtctgcagccttactacctccttgattcgacgatcttggcttatgattttattgatcctgccacgttacagacattcatgtgaatggagatatatcgcatccttccaatactgcctgggatttcttcagagcattttataggtgctggaacaagtggaatttgtttctgttatccaggactcaaattctattgaccgaaggggaagaaggccatcgatatcaagttgatatatgaatggatacagggactacctaaccgaccatcgtcaatcctcatatgttcaagctaccagagagctatgcacaatgtgattaccacgaacgaggcggccctcccatcggacaccccactactacacggtgtcgaaacccatacagaagaactggaaacaaaatttacggtatcacaatgtggccggtcaaggccatattggctctcagtggcctgacgtcagctcgctgaaattaaaaataaaaagaagagagagggagagagacagagagcgctgcagtgcagctaattgactgataacgcagaaaaaaatttcaactacaactaatgggttcaaactcaaccgtgatgtgtctttggttctttgcatctggcagcgtagttgcaaccttcccagatgggacgacatcacaaagcagagaagcagatccagaaaacatactatgaaaagatagtcctaatttcatcagcacttcgtctttagctgagacttttggcaacgtcagagggatgatattctggagaaagtgtcgccaccatcttcgtgacgccgttagtcgtataaggaattatcaaatcccaaactgctttgagcaggaatactatgcccattaacatcatgcttattaagccacctctcctatcctgactcccttttttttttctgttctttctctcatttcttttctttgttaaatccacctatacctactgttccttaacatttgattcttacattatactacagcctgtctctcattccctatttctgtccctcatagaaggttcccactgttgactggtctatagcataacccacctgtatatagatattagctactaagccctactgcctaggtggtaggcagagcgtgcatagtctctgactgaaaaacgctctctaaaatggaagaataataataataataataataattagttagtataaagtttattagtaatattactattagataaattagagttattatcttattaaagagtctaaattcctttatttgggtagctaataaggctcctttaatcaaaatataggaggctacttatttactataatttatttacatgtaattatttataacttattattagcctttataatagttactggttattataatgcttataaattagacttaattagagagatagtaatatttatagttaattaggaattattatttaattaaggtctcttagaggggattaataaactaaaactagtagtctagaattacttaactaatcttagcgttagggttaaaggactaagggttagagggaccttatttaggatatttactaagtgtaaataagctaattaaaggactataatataaagagcctaggaactaatagtattatagaaactaataactttattattaataaagatatatagcctagataaggtatagttcttttttaataggttattctaaatagtatataataatagatatagaaaatatcataaattaaacctttaagacctttctacttaaatatagtaatattaatagtaaaaatataatctagtttagacttaactagtattactaatatagaactaataaatattaattagggattagtcataattagtatacccttagtgtaattattaccattaggcttattagggatattatatttatagttagtaaatatttataagtagttatattcttaattaaacctataatagttattagctctaattactaaataaggaagactctttaaaagctttttaattataaggaacctataataaattataaaggtattagccttaaaagtattataaaattagttatagaaattacttactcttatcttattaaaagtaataatattattaacctattaaaatacattatattagataactctattaaaggtaatatttaagcctcttaggttattaagaataggattattaattataaaggaaccataaaaaagatagaaaataaggttatataggggaatagataatataattaaataaagggaattagataatctaagtataataactaatatagtaataattaaataaaggaaattaggtaatctaaatataataaaattgtaaaaatagatattaaagaaatattttaagagggtactaaggggatatatatatttttagtggaggggaagagttattaataaagtagaattcttaaaaggttaaagtactttagggaatataatattatctattagtttattagtattatcctcagtaatataagttaatagatatttataatataagatagagtaatatagagttagctatagctaaagataggtatatataaatctaccctaatatattttagtaactaaccttaagatttattaatagttattataaatactaattaaattaagaattatagctaagttgaaataaaataaagcttactattattattataaagcttagtctaataacgtaatccaccaccgagctgcgcggccaccacctcagccaccccctatcatcagatttaccaatgcaccacgtcatggctgatatatcaaaagaagggcatatgcaattagcacttgaagcctataagaaaggtctttttccatcaaaaactgcagctgccaaagcttttaatgtgcctccaaggacctttataacacgtgttaataggactactgctcataaagattcaactgcaaattattacaattgacagatactgaagaatctacacttttagcatggattcttgatatagaccgacatggtttactctatgaatattaacagtatgctatctagcgcaattattgctttctgcacagttatcttcatctcaagaagcttctattggggagaactgggtaaactggtttatcaagcgccataaagaactttgctctaaatacagccaaaagtacaattatcagcaaaaatgcgaagatcgagagcttattaagggctggtttacacagtttcatgatgctattcagaagtatgggatccttgagcaagatatctataatatggatgagactggcttctaaatgggtgtgatatcaactgccaaagttatctgcagttcagagacaagagaaagtcatgcaaagactatataacctggaaactgcaaatgggttactgcaattgtagcagtaaatgcaaccaaccgtagtcgtcgatacttaacgatggtggttagggaaggagtcaaggagtcttcctaactctgtgtcgttcacgagcacgcgacggtctaactgacccgggtctcctttcttgagacaacggccttacctggcgaaggggctcttcctcgaacgatctctcacaagtataaaggggtctcgcaggatcacacgctaaggtatctcagataaacaaataacaacgactaggtcagaggcaacgcctactagagctataccgaagtataccactagtagtaagaagtcttactgacccccaaagtaagtatcttagtaacagtagaataacggaatgaattgagcgcgagtaaggaaagactagatacacggctggaattttccctccttttatatctcttcctgagtataccattagtatacccttcagtggtatgccattgaggtcttccgaggccttttggtatacctttcttggtatatctgaatggtatacctataccatgtcacgtgatctctgatggtatgtctttgtgtagtttctgcctcgcggggtaattgtttcatcctgcatcgctgtgttggacagcgttgtctcctgttggttcataacaacagggttcaaatgacctttgctgttttaatatactactactccagagcaagaattggggcctttattcctgatatgttaaaagcggatgatcagggactccaatataaggtatttattattatcctatactatttggcatgtctctgaacgactttaggacatcaaattatacttctattgcaggcctgatggcgaaaaggaaattttttctatcttagtcaaaaatgggtcaaaaataatcatgaccccataaatataatgtaggacatgctattccttgctcctaagcaaaaatcctgactagcctttctaggtttcatgtagcaattgtgacggatccaattccaggcaatagagcagtttcttatcactaggagcgatctaaattacaagagactaggctgggaggagaggagaagaaggaagggagccaggtcgctagcgaggcgatttatgcaagtattctgccgtacctatacctcaccgcttttctcaccgctcacgtgacgacaggcaagttgaatcgtcacatcaccccccccctccaaaatagagcctgccctcaggcgatggtaaggtcaaattttgccagaccaatcagagacctcattatgggttactgcaattattgtagtaaatgcagctggatgggccttacctccacatattattcttgcggcagagaatcaccaatctcaatggtatcaagctatcccaaaggactactgaatcagtatcagcaagaatggctggacaaataatgagataggccttgaatggcttcagaagacctttgagacctatagagcttcatacacagttgggagatatcgactattgattctagatgggcatagcagccatgctactgcaggatttgataaattctacacagagaagaatattattcctctttatatactatcacattcttctcacctgctccaactgcttaatcctttggcccaggcaagacaccagctgatatctactaactagattagcaaaagaagcaaattaaacatcactgaagtcatcaatcagtttctccttctatagtggaacaggcagttgataaggtgattaaaagtgcagaaatcaccatgcagaatactatcctattacagcaagagattcatcggcttcgtatggaaaatcaacgtcaaaaacagaagcgagaagcacctagatactttatttaagcaggtggaagcttgacaggtgctgaagggcagcaaaaagctcgagagcttgagcagctgcaggaatcatctcaacgaccttggaggccaccaagatgcagtaattgcaatcaagaaggccataattggcttaaatgccctagtaaatagtccctccttatttatatagtcaaatatactgaattttgttgcgcaaaaaaagcttcatctccaggcattgttaggcgctttcagccgtggttggggtggcagctcggtgtccgattacgttaagcttctattattattaatacctatattactttgtacctcttatatcccctccctcctttagaaaactaaaagttaaatattattaaaatctaaaggtagtaaaaaaataactatcttaatattaggagctttatccttcctttatttttattatttatatctataatactaaaaggcctaatagtatcttctttatttatagtaagtatatattctatctctttattaatacctttttcaagctcctatagaaaataagcttttattcttaaactataaatatacccttaaaaaggtatattatctaattcttttagaagttatatattattaaaaacttatataaaaagactaaactaataaaactaaagctttataaagtaggatatttctaacttaatattatatactagaataagttagcctttatctaataatatcctttatggcttatagtacttattaaatattctttattcctttttaaagcctcctaagtctataatatatttctttaatatctttattttcatatttaatttaatcagcctatatagctaataatttagtagtaatatatatagtcttataatatcctctatattaatacttttaataagaaggataagcttataattatatataatcttagtaggtattatccctattaaaatatatagtaatatatttagactataataaagatatatacaaaataccttatctaaagctttctattacctttaattaactttttaatactataataaaagggttataactatattctatataactttatttactcttagattatctagtatgaatatagtatacttaattttataatattctaagagtacttaggtaatattcttagtttttacctttattagttataataactagtatataattatattagtaaataatatctttataaataaacttagcattcttttatagttactaatattaataaatattttttttagctagcttagaagttataataatagtgaaatatatctttcctttaaataatagagccttataaatattaaggtagatcttttataatcttaataattcttaagccttttatatattagtatcttacctagcttatttttagctaatatccttaataagattatattaccttttaatccctttactcttactctaagattaataagatatttttagtcgattaataactctatatcaataccttaaataaaaagactttaattaaataattcttagtcctttatatctatagctataatatcttctatagctattaagttagattcataagctaattaataaccaataactataataaaggtaaataataagctttagactattatataaaagtaaactataatatataagtagcttcctataacttaaataataaagactaacgtatttcccggctgtttcgatcacccggttgctccgatcactagaatacctatacaaaatgcgttcttttgtacgctcataccacaatgtctatattatgtcctggcctttaattttaaaatcagattatatataggtataactacttgtaagagaaatataaggttaatattatatatattgctttttagatacctattttttaattttacataaaaattacactgtattttatgttattccagtaaataatagagtagactacttctgattaatgctgtatgctgtaaatactttataattaattatttactggaataatataaaatacagtgtaatttttatgtaaaattaaaaaataggtatctaaaaagcaatatatataatattaaccttatatttctcttacaagtagttatacctatatataatctgattttaaaattaaaggccaggatataatatagacattgtggtatgagcgtacaaaaaaacgcattttgtatgggtattctagtgatcggagcaaccgggtgatcgaaacagccgggaaatacgttatagctatatctttatataaataaaacctaaaaaaagattagacttttttaataattattagttaggcctaattaattattattatttaaacttttcttaaattaaccttaattctactagttcttataataaagcctaaatatttagtctcttatatagaatttatattttctaatactagcttaaaggcctataccattaaattattatgacttttttttatattcttaatactttatcttgttattattaaagataaaaaggttattaataaaagtagttataaacttgttaaaataatctataaaaatattattaattaattattaaaaggtaactagattatttattaatttaaaagctataaccttatatttataagtactatagtaggtttagaatataataagtttttcattaaggtatatttagacctaatagaatccctaataaatatctaactataaagatattagccttatttaaatactttattaatttcttaattaaaagtaaggaataatagtctttttctataaggatatttagcttataataatttatataaaattaaagtcttttattagctttataagctataaggataggtaaaaaataaattattagataataaacttttttaaattatctttaatatattatttagctacttttaattcctctattaactatttatataacaataaatatcttaatatattctttttatctaacttaattaataattataggactataataataaaagtaaagtatctaaggccttttttaaaaatatatcctagtatttataataataggctagtagctattttttaatctttttttccctttaagtattctaagcctcttttttatttaatttatcaatcttatataagctagttaggaagattttattatcttttttaatatattaaaaagaatattctattactaatagctataatattaatttttgaaagtatctttttttaactataaattctttaattataatagagtaggtaaattctttatatatattaccctctttatctttattaatatatcttaataatcttaattatatatataggctaaatatagtaatatttttcctattatatcttctagtttattaattaatcttattaattagtatcttattagtagtattcttttactatttatttatgctataatatagtttaaggaataggttatattacctagttataggcctagtctaaaatagttatatcctttagctataaaagttaatagttttaataattaaataagatactaaattaggtaaattatatctttttaagatattattatagtatcttagatttataattaatattaataggtttacttagtattatttattaattattaaggttaagataattatatagataataagtatcttaattattataaccttaaaactatatatttattaataactaatcaattaagtataataaagctttctttttttattttaataattctttaaagtctaattatacgaggctatattatttttatttaaaatagagactttttaggctattttattttctagctagctaataatatttctaaattcctttctatttacctttttcaatacctttaattaagcctagttcttttaataattataagctaaatacctaggtcttagataataaaaatactttctttttttgtaagggtctattaaagctctaagtttatccctagttagcctttttttattttttttaaaaaaatatcagttattagagttataatataagaaggggtataactaggctagttcttattaaaggtagttctatagtttataaaaaaaatagttatattaagtatagttatagataattttaagataatttatagtctaagaatagtagtttatataaaaattcttaaaatatattattagcttttaaggccttaaatataattagcttttaaagcttaggtataatcttttaataaagcttttctttttaattatattaatattaatttctgttataagataaaggaacttaataaagaaattatagaatttattattagcttttataaataatatatagaacttatatctaatatttataaattaattagggttataaaagatttattttaggtatttaaatatattatttatatcttaatattaatttagggctttttattttaaatattttataatattgttacatgctgggctgacctaagtcactgatacttaacatcagtggttagggaaggttcacagatctaatccaggatctcatatagtgatcaactcaacaactctcgcgctcccaacacgcccccccaatttgggggtattcgaactcgattttgacaccaatttgttctactcatcaaacttaataacatactagatttttatttcaaattacccctttgttgtcagttgggaagaccccaaaaccccccgtgagccggcaaagaaaatttttgttttccctcccgctacgggagcccagtcaaaccacccgtgcaaggggtggaagccgcgccagtagaccttccagccgcaccacgctacattggtccctgcacagctggcaggggatcatcaggaaactcatgaccttcatgcttttgccgtgcaatttcctgaagcttactgatgtcccacttagccctcatgactgcaacttgtgcccaaggcattaattcggaattctgtccaaggaattcgttcgaatccagagcggggagtaaatattaatgcttgcaaatcgttgtgcgtgtgctctgcctcgacgaaaattaggcatgacccagcatcatcttccaagttgaagtcctcctcctccttaggaaattgctgggaagtgaatgcagcatcccagatagattgcaagatggggaggcaatccataactgcagaatgttagcgcaagaaacgaaataatggctaaggttcaaaaacctagcaatcgatattttgactcgtcaatgaatagatatacgagagaaaataaacccacctatagatattggctgagccgtatgtttgtaattaaaaatacacgggcgattcctaacaacagccaacaattatgttatacgaggtaggcgacggcaaagcgaaatggaactgagtaatattttaggccggccgagttaatggaggtaagtaatgcaagtctggtcaagatcgaaattcaaggcaattgttgagcactcagttgcaggaggcagatcatcttatatgatcaagccctgggttcatgatctatccattatctgaagttctagcaaacgttatgcatctagtgaggtgctgcgtcttagaattactaaatttgtaaagaaagcctggtctacgtccataatgcaggcaataacacattgtctataaacagggcattatgcgttgatagatgttgggatctctcgtcatggtttcgagctcttgattggctgcatcacaatcctgaatgctgttttcataccactgaatcctcacagtctgtaaggtcagcatccatcgtgcgtcagctctagcatgctactcacgattaacttggtgttggtgttgcagctcttattcagtgagagaaaaacgatagccgaatccaaaataaggcttgactggattctgatgaaaccttataacttgtaagagaaatataaggttaatattatattatatatattgctttttagatacctatttttaattttacataaaaattacactgtattttatattattccagtaaataatagagtagactacttctgattaatgctgtatgctgtaaatactataattatagtatataaaatatctctttaatatctttaaagcttgttgagatatgagcgtacaaaaaaacgcattttgtatggtattctagtgatcggagcaaccgggtgatcgaaacagccgggaaatacgttattaaagaggaagattatttagataataagacctataaaatgtaaggcctaaatagttatataactcttattaaataaagacttgataaagaaatcttaaggtttaaggctatataaaataataagaggctttaaataaaaggagggaatcaactataataagatatttatattaattattaagctaataagctataaggctctgttcactattatagctatattagattaggagattaagtaaatagatattaaaatagccttcctttattactagtactattaataatgtctatgttaaacagccaataggactagataatgatgagggctctggaggatgagaaacagcttgattcctataatcaggcctgtagcctacaacctacatataggcacctataagggcagtaaggcctaagtaagctgagacatatatctactagatgtctagggcatctattatacccctattaataagcctttaataccttttaaacttcctaaataggtaattttctattatataaagccttaataagagatactgtccttaataccttttatatcctattctataatctgatctcccttatatactataagccctaatagtttataaaaatagttatattttatttactctaatagctttataagcctatttattaggttaatcttactattaatctactttagtttaattaggcctttcttaataatattatagatagagcagttattaatctactttattataggtaagtatctagacttattaataatatttagtatttatattattaatatagactattatagggctattctttttaagcctaagtataactataagcttataaagctagatggcttcttttataactataataaatatatagaattctataatatactagatattattataaaggtctatttttttaaagcccattaataggtactctaataaacttaataatatatactttaattaatttactattattattatattattataataagtcaatatagactataatgcctttatatagtttagagttaaatacaatactaagattataatttttttaaatgtaataagcttttataggcgtataaattaattatatttggttttatagattacttttataagtaagagatagtataggtaatattagggtatatctttattactaacaaattaaattatcttataatatatatattatatattattaaaaaatagtttactttctttatagatctttagatacttaagatttataaggatcttctttaactaataattagttattcctatttctaaacctataaaaggataatagtcatattatagtcctaaataatataatagcctaaaaatttacttaatttacctaattcttttaatagatattacttatataactcctttttaattttattaacctccctttttataggggctacaataattatattatctatataaataattataatttatctaattattatatataaatataaagatcctctaataacaatgtaaagctaaataaatataactttatattaagagtcttattttgtaggactagattatataattctattcttccctaggatttacaccttataaatataactatagtcccccttataactaataaagtatctaataaatattcttaggcctatcttcttagcctatactctatcctctttaggaatatatttatagtaatatattccctatatctatatatagtatattattatctctatatttatttataatacctaaatccttttagtatacctataaaagtaatttgctttctctaagatttataatttaattaattatataagtagctatattaattatatatagctaaagctatagtagtaagcctaagttaataattattatataaatagtttagttcaaataacatatattattctatgatactattataattaaaggtttatagtagagttaatttaaaagataattctttttagttctccttaaagatcctgcccccctaacctgtccacccccagatctgtctactaccaaaaaattaatccaaataatatttttgaagctatttataatattccctaataagcctactatttaaataggaaagattataatctaacctctaatatagtatctgagagttttttagcttcttttttaagctcttaggccttaatatatacctctaaagctatagtattattaagagccttcttaatattcttaatatttataaactaaatatttagatctaaaactatcttttttaggctttttgactcttatatacctataattacgaatttcacttaaaaattatagttcttttagtacttcttatatattagatttcctaattactttgcctatttttataagaactatatatagtaatctattaagcttttgcttactataaaggagctatattacttatatatactacttattctatagagtcctgaggatatttagatctaatttagtatattttaggctttatagagttataggccttagagaaaatgactaaatttatagaattaagtatttttaactaattatataatataatacctcctgctttttatctgctttttagtatagatagtattatagagatctcttatataaaaatatagtattatataaagtattttttcttaattagagtagtatttaatatttttattaataaaaaaatacttaaatctagaggctatagtatataacttatattagtagtaaaaatagaagctatatcttatttatatagtaaatatatagaaatttaatagttatataactactatagctatctagaattaataattaatatctactatcttttacccttatttctaataaaaaaccatataaagctatctagatataatattattagaagtctatatattttctaatattatataatactactaatctaggatttaagctataggaaactataaggtttatagatttctccctttaaagataattataggcttgatttttatactaatagtattaatagccttaataatagtaacctacttattattttctagagcctagagataaatatatttctttctagcctctataagaacctaggcatttatatagatttaaatatagtctattcttatctatattttatatattttttaggtaggattatatgttataatagaatagcttgaagctaattatagaattattatattgtattatgctataaattctagatcctttttatattaatctattaccctatataaaaagaaatatagattctactttaagaagcctaaagtctatccttttcctagtagtatagtattattatttattttaaggatttaagatactatttcttatatataatatatataagagggaatccttaagaatcctacttaattatctaattaactaggatttcctcttatataggagttaattactaatactatttataactagtatactttaaagtaatattagccttctaattatatagtattatctttaggatgccatacgctatagtatagtagcagcttagagtaaattaattttactatatttataattagtaagagctatttatatagcttttttataagaatctattttgaataagatttggtgattttataggtagtttattattaagcaacatatattaatgtggtagacagattcaggggtggacaggttaggggggcgggatcttaagtaataaagttattaaattctcttttactattaaagtaaaaatatatcaaataatagcctataatattatagaacctataaaaaaataatcagcctttataatatattatccttattcttcaagaattctactttagggatataatatttattattaataattataagataatatctaaatcccttataactcaataactcgactagtcatatattaatataaaataaatctctaatattctttaagctaaagtagtatgaaaaataagatattatatcttaagtaatatagtatattttatagtaaaaattaaggtctataaaggtattattggctactttttatagttagttacttaaaggtttagttaactatagtaagctaaatagtaatatggtaataatatattactttattatattatttatatctttatatcttataaaagtagcctataaatagctatagcctatttcgtttagtcttaaataaaaaatagggaataaaaagattatatttaatattattatgctactatactaattaagtaaaggagaaaataatatctaattatttaagactataatttataatgtaatcggacaccgagctgccaccccaaccacggctgaaagtgcctaacaatgcctgcagatgaagctttttcgcgtaacaaaattcaatatatttgactatataaataaggagggactatttactagggcatttaagccgattatggccttcttgattgcaattactgtatcttggtggcctctgaggtcattgagatgattcctgcagctgctcaacctcttaagctttttgctgcccttcagtacctatcaagcttccacctgcttgaataaagtatctaggtgcttcttgcttctattttcaatattgattttctgtataaagctgatgaatctcttgcttgtaataggatagcattctgcatggtgatttctgagaggtctgcgtcgactgttgtagtagacgcgtcagaccgtatctagaagcagtagaaatggtaagaaatgagtgggttgagcctagtctaatgtgacggatccaattccaggcaatagagcagtttcttatcactaggagcgatctaaattacaagagactaggctgggaggagaggagaagaaggaagggagccaggtcgctagcgaggcgatttatgcaagtattctgccgtacctatacctcaccgcttttctcaccgctcacgtgacgacaggcaagttgaatcgtcacaactaataccgcccttaattaattaattaattaatttaactagatgtaatatattaggtaactattgtcaagaaatgttgtttgtcgtttccctaattctattaattctattctaattgattgattgattgatttgttgccgtgatggagagagcgagggagggagggatatcaattgagatatgaaaatagggaaggctaagtaagaagatagacagacagacaaaaaataagagtggacagacagacgataatagatgtaatccctgcctctgttctatgtttttttttcacgctcatgtgtggttagctctgaaaatgaaagaatgaaaagaaatatatatatatttgatcccctatactcctggcctcgtgtaattaagacgttcgatcatcatatcagtaacctgcacatacagcacatacagtatagtatatatataggtagagtttaatacatgtaaaaaagacaattgaataactattattattttttaaaaaaaagcacaaccgaaaaggtatacagtctatttttggctccaggatatttgtatacctgtgaccggcaatttatagcctcgatctacatacaaagaccaggattcaggaagaaaaatcgtaagtaagagcaaactagtctgtcagattatgtagtacctaggtaggagatatatactggcaaaaataagccagtatataaaaaaaagttgggtattcctgtttgtgaactgctggcctggatatttacttacttccttatactatcgatcttcttggcctggaatgggaaatgtagcgacttaatggcatctgcattcgctatgagcaatacttgatgaggctcaaaggaaggatcctctatctacatacataagatggattatccatacacgtgattgacctgtggtcatggatcatcaatatgacccgagaatgtatcgtccatacgctccatcgacaaaggtacggcgtcgtaccatggcaggaagggtcaagggcaagagtagaataattcttttaattaattgaagtcattgtcattgacgcaatgacggagatgtaacgtcccagtatatcaatatatcaacgagagagagacggggaaagaaaagggggaaataaaattagcccctcaatacagaagatccagttgtacgtacagaacaatttacccactcctcttcgagatggttagacagatagatagataggtattctgctgattaaccttctagcttgtcgctcttcactccaaccaacaggtgtatgtatctactttccaactgaaaatgcccttttttttgtaccaacaattttgaccacaatgctgctcaaacatgatactactgatgtctctagggagggacgtttacaattagctcttgatacttataaaaaggcctttttaggttgattactaaggcagcttcagcatatgatgtccctccaacaacattaaagagatgtgttaaaggggtaactgtgcgtgctgatatagctgcaaattgctgcaagctcagcaatactgaagaatctatgcttaaatcggatccttgatatggactgatgacgattactaccacatttggcaactatatgacatctgacccagctgctgctctctgcacgcctaaatcaactagcttctatcagtgagaagtaggtgaatcagtttgtcagccgttataaagaattgcactccaaatataattgaaactatgattatcaatgtgccaagtgcaaagacccaaagctcattatggcctagttctagtgagtttgcaatactatagaaaagtatgacatccttgaacaagatatctataatattgataagacaggcttctaaataggtgtgatatcaacagcaaaagttatctatggttcagagacacaagagagctgagcaaagaccatacagccaggcaatcataaatgggtcacagtcattgaggcaattaatgtaactagctgggccctactactgtaagtcatttttgcagcaaaaaagcatcagcacaaatagtatgatcttgtcctatatagttcgcatattagtacaagcaacaatggctagaccaataataaattagccctaaaatggcttagagagcattttcaagcacatactgaagcttatatagctagcagatatcatctcttgatccttaatggctatagtagccatgtaacagcagaatttaacaaattctgcatagagaatcgcattattcctctatatatgctagtgcattcatcccatctatattagctgctcaatgtcagctgttttgcagttttaaagcatatatatagacagaagatacaagcaatgatacagcttagtattcatataattaataaagaggactttctagagctctatcaaccaatgcaaatacaaactctatcaatagctaatatatgtagtggctttgctgctactggcttatatctattctagccagatcgggtgctttcaaagcttcatatacaggttaataagacatcaacactgccattgatatcttatagcaatcaatcaaatagagtgggtaagacactagctaatatatattaattagagctgcaaaagaagcaaattcaatctctctggcactatctaataatctcacctttagtaatatataaggcagttgacaaggtcattaaaggcatagagattattatacagaatgctatcctactatagcaggagattaagcagttttatacagcaaatcagtatcaaaaaaagaagtaagaggcatcttgatgctttattcaaactggtagaagcttgacaggtgcacaaggacagcaacttagctaggagcaggaccaataggagcaggagcaattagagcagtcatctaggccatgcaggccaattagatgcagtaactgcagtaaagagggtcataatcaactaagatatcctaataaatagtgccttttttatatatatttaaatatatttaattgcatgaaaaaaagcttcaaaaacaggtactggttttgagggccaataacttggtggtggaccggaccgcttggtgtcccggaccactcggtgtccgattacgctataagctaaaataattatttggtactttaccctaagtacctttttaaaaatattaaggtttaaactaatctttatagatttaggtattttctattataatttaatatatattattatctatattaataatctcctaatttttagactattaattaaggagatttagaaggttaagaaagctctaagtaaatatttttatataactaagtctatataattatgacctaggaataactattatatataataaaaagaattaaattattagactttctagtatagatatattaagaaagtattaaataagtttagtataaaagactataaactagttactatactaatagaccctaatataaaacttaaagatataaagcctaataaggaaagtaacccctaatagataattaaatatactaagattattagatccctaatatatataatattaggaacttatatagaccttatatatactatattagtactaagctagtttatagctaaacctattatagcctatcttaaggtagtaaaataataaatcttttatgattttaagggtgcttttaaccttatacttgtttataaagggaattatagcctctctataagtatattaacattaatgaagtagaggaggttcctatataatagtctacctctagttatatctttaatctagggaatagggtaattagctagttattaaaataataaccttctatagtactattattacataaattagaatatataggtaagatataagtagctaaggaagctatctagctctaatacctacttagatatttaggatagaagtcaaagggtataatagttatctatatagatcttagctcttataaccttatacctaaccctatacctatatattataataattaaggagccattatattaataaagaatctaatattctataacgtaatcgggcaccgagctgccacggacactgagctgccaccccaaccacagctaaaagcacctaataatgcctgcagatgaagcttttttcatgcaacagaattcaatatatttgactatataaataaggagggactatttactagggcatttaagccgattatggccttcttgattgcaattactgtatcttggtggcctctgaggtcattgagatgattcctgcagctgctcaacctcttaagctttttgctgcccttcagtacctatcaagcttccacctgcttgaataaagtatctaggtgcttcttgcttctattttcaatattgattttctgtataaagctgatgaatctcttgctgtaataggatagcattctgcatggtgatttctgcacttttaatcaccttatcaacttcctgttccactatagcggacaccgagctgccaccccaaccacggctgaaagtgcctaacaatgcctgcagatgaagctttttcgcgtaacaaaattcaatatatttgactatataaataaggagggactatttactagggcatttaagccgattatggccttcttgattgcaattactgtatcttggtggcctctgaggtcattgagatgattcctgcagctgctcaacctcttaagctttttgctgcccttcagtacctatcaagcttccacctgcttgaataaagtatctaggtgcttcttgcttctattttcaatattgattttctgtataaagctgatgaatctcttgctgtaataggatagcattctgcatggtgatttctgcacttttaatcaccttatcaactgcctgttccactatagacagagaaactgatcaatgacttcagagacatttgatttgcttcttttgctgatctagttagtagatatcagctggtgtcttgccttggccaaaggattgattactgtatgctgtagaagatggtattagtctcttgagctagatatgaagctttaaaaagcactctcttaggtaaaaatggaactaggccagttgctgcaaatctgctttggatatttgatgctgataaagcttgttgatggactataggatagatatatagaaaatcttccttgtcaatggtatggattcctttctgtatcatctccctaattttctggccatacaggcactttaatggcaagaagcagctgacatcaagcagtcagagcaggtaaaaagaatgtaatagcataaaaagaggaataatattcttctctatacagaatttatcaaatcctgcagtagcatggctgctatgcccatctagaatcaataggtgatatctcccaactgtgtatggagctgtataggtctcaaaggtcttctgaagccatttaaggcctatctcattatttgtccagccattcttgctaatattgatttggtagtccttcgcttttattattacagtattttattattaattaatcttataatattaatatctttactaaagttattatttaatattaattttattaaataattaatattaaaaagattaatattaaatttagttttataattattataataattaattcttattagatacttttattttttgtaaaggtattttaattataaaggagctctttaagggacctttatatctaattattaaggctaataacctataaaggtaagattatataacttttttctctaataatagaagctaactttattaaggtataaataataagtatcttaagatagttcctttaataaataatatttacctaacctttatgagctctatatctataattttaatagaaactggtattaattatatctttataatcaatattatagtcttttaatattagtttaaaaggttctattaataccttttatatctattatattgtcctaagaattaaatattaatagaactgtagtctattagcttaatatatttttattaatagtaaaattattagttattatagtcctaataattcttaagcctcatatatattagtatcttatttagcttatttacttttaataataactttaataagattatattacctcttaatccttttactcttattttaagactaatgatatttttagtctattaataactttatattaataccttaaatgaaaagaccttaattaaataattcctagttttttatataattaatttttatacttattaaattatatttataaattaattaataattaataattataataaagatagataataagctctaaattattatataaaaatagattataatatataaatagcctcttataatttaaataataaaagactattagctatttaaataaaaggttttaaactctaattaatctctttttaatactatttttaaataagagtataaaaaggtttaaatatttataaaatataatataaagttaattattactaaaaactaataactataagtctatattaatatattttaataattaatcttaggatttattaataattattataaaggctaattaaattaagagttataactaagttaaaataaatcttttttattattataaatttagatttaataaggtaatattctttattaaatttattattattaatctataccttaaaataatatataaggcttttataattattaaataaatcttattataaagtctataatttaagtttagattttaaaaaatataataaaaacattaatttttaattataggactaataaaggtaaagagatataattaatattttataagactttaataccttattctttatattaattattattaaaattatatttatttaggtataaaaataattattttacctaaaaattattgtcatatattattaagctttataacctctttataagtattaaaataatatgattaagaaagaaacttaggtaaaaattacctttattaaattattatataaataaatctttttataaaactagcctcaaaatatattatatgattattaataataaaattcttttttaaagttctttaaaataagatatctttctaaattaattattaaagatataattcttttttaaaagttcttatctaaattatatattcttttggaggtagataatttccaaataaggctatatattagtgtaaaatatataaatataaataatattgttataaatattataaagtataattaaaagtatttattagaacttatttttaaaaataattaagtttttaaaaggtttagaattattaaaaagatctaaatataggtcttataaggtataatgaataatattaaaaatatagtaataagttataaaggtcttatcttaaataaataaataaatttattaaaaaagcttaattaattaagtcctatataaaatattataaatataaaatttagtaatatcaataagaatctttaagtatttaaaagtagttttatttttaaaaagaaatggagctattatattaataattataatataagatctcttttttttaaattataattatatagtatctaataaagaagttttttttcatatttttaaggctataaaaaagaactatactataataaagcttccttatatttattaaagaatctagttataagctatatattaattgttattaaataaagcctcttattaaatagctaactttattagaatagattagttataaactaattcttaaataatataaagattagtattcgatcttagtaagcctaattattaataaattaaggaagggtaaagtcttagagttaataatctttattttataaatctttccaaataagataccaattagaatctaagtccctataggtactctaaattaaaaaaaatattaaaaattatagttataaattacttaaattaggttattataaatattattataaaactagttctagataatataggtatctataagattattatatattataataaagattaataattattatatatactatcttatttatatttaagatacctttttaaaatatagttcctacttatttttttaaataataatcctttttaagtataataagcctcttaaaaggtattataaataatgttatttattatttaaaaatctttaaaactaaatagactagatataataataaagaggtattaaaggtaataaacttctccctaaagtaatataataatatagatttaactaatctaataggaaggtttttattaaaagaattattaccttttaaggatttaatataattataattaaatattaaaaggtactgaaactagagagataaaggaggacttactcatagaatcttattagagctattttctactaattaatagcctagagaatattatctataataatatgtatttagtaggttataaaatactgattaaggagataaactattaaaggcttaactaagggattattcttataaatcttaaatcctataatttactaagtatattctacagacctaatatagctattaatatattattaaatcttattaactttagtataaaactctaaatttatataattaggacctttgtatatatataaatatattttataaagtaaatactattataaattttaatattaatataggcctaatatttctaatataaaaaagggttattattattcatccattttagagaccgtttttcagtcaaagactatgcacggtctgcctattacctaagcaataggacttagtagcgagtgactaaatacatgcagaaagaaattggttaggctatagtccagtcatctatggtatccttctaagaggggctgattggtagatggcctgaggccaattggtagggctgattggttagggagcttatataagctcaatctagtggggaaaagtaggaaataaaagataggtaagcaggtggtagaaaacaaatcacgagtcaacgaatggtagtctggctagatggtagaggctatatgttgaatatagcctaatgtaggctctagatatagatatctagatattcaacatggtaattgctcgatttggggcagaaatctattaatagtaagcaggtggtcagtcggtcaggtcaaagggggagtccgagtaggggagaagggaaaaggctagaaaaccctccttcccttggccccttcctgttccctaggtaggccggtaggctctagatatatattttatatatatctaggtcttcgatttggtacttgctcgatattggggtcggatatcgatggtaggcaggcggtcggtaggtagtgaaaaatttttcgtaagagtagaataggtcaaaacttcttaaatctggcccaaaaaactcccagaaaaagaatatgagctcctcttggattcatcagctttgtaagactgactactagtctcagtcaccacgtagaggtgagagctcgtcgaccgagataatatattatataaaaagcttctaagctatttatgtaaaaaaactagaaatacattaaataataataattatatattatatatattagttttgaagtatttatttaagtatattatattattttttaaaacctctaaggctttaattatatataatttcttaattataaattaatagctagctagctttatttttttattaaatatgatattatttatttatttattattatattataataaattaaacgttttagactattatatttattaaaaagtagaaattataaatactagattttttaatattaattattattaatttttttacttatttctttgttacatatttatttctttaaatatttctttaaatagtctattttataatatttttgaaatgatatttatatttattatttttaattatcttacgtttatataaattatgaataattctataaggctttattatagactattataggtataattaaattgataaaataatttaatatataattaattatataattaagtataaatattataataaaaaagctattataaggtatataatatttataaaaaatctaatatatttataatttataatttatatttattttctataaaaaatgaaataaaagaatattatagtttatgtctggattattattattttaatatattatataaaaagcttttaaggtttttattaaaaattatataattaaaaatagcagttatataatatattagtttaaatattaaaaattttattttattttatttttgctttaagcctttaattatatataattatataatatataaattaatatttatttatataataaaagtctataattatataatagtaagctatataaaaagttataaaagattaataaagaactaattatataaaaatctctatttatttatactagtctttactaatatccttttttattcttaccttaggccttaattatataattttaattatataatgttacatactagattaataattagtaaactttatttaaatagttaataaaatattatttttaaaacttttagtatatttttatcttattatatttttatctaaattatataattattatattaactacgtataatatacaataaaaatattaagtttttaataaaaaaatactaaaaatattttataataaaaatctaatatataaaatttaattacaatactaataaaccgaaatataaattaaaatctaaaacaataaaaaaagtaatataaataacttaataattaatattaattatattaatttcttaagatctataactatacttaagaactaaaataaaaaagctatattaagactatctaagaatagcctaaaccaaggctaaaaataatataatatttaaaactatatataaaataaaaaatctagaaaatttactttaattaattatacatatatttatatttataaaatataaaattttaataaaattataataatattatttaattaatataagtatttttataagctttatataatttaaagtctgtataaatttattaatttagtgtttcttaaaaattgaaaaagaataattatgcttaaactattaaaaattaaaaaacaaataatgtaaagcaaaattctatataaacaatacatttattataattttaaataatcaattaaataataaaaaggcaactaattaaaataaaaattctacctaattgataaaatagaaaaaggtttatataatttattgaaatttaatattttatattaaatatttttaataataaatttaaatactttattataatatatataactatttatattaataatttattaatttttaaattattattaatataaaaaattatattaagttactctatagctaagattaatataatctatattaaaatagctagtattaattataaattatttttaaaaattatttttaaacttaaatagtttttagttttagaaataaatataactaaaaaaaagctttctttaatttaatattaaataacatattttatatattaaaccttaataggtataatattatgtttaaaataggttttaggttaagttataaaattattaataaaaaaataaataaagtcatcaaaaaaaaaaaactctggcgctcccaacacccccccccaatttgggggtattcgaactcgattttgacaccaatttgttctgctcatcaaacttaataacatactcgatttttatttcaaattacccctttgttgtcggtgtgagctggcaaagaaaatttttgttttccctcccgctacgggagcccagtcaaacaacccgcgcaaggggggaagccacgccatagaccttccagccgcaccacgccacactggtccctgcacaatacttttatagtgaaaaatatagcactatagagttatatatagttgactagaacttctagtcattatatataattcctataactatatttgaatctatagaactattcactaggctttcagatacgtattttgacagctattttggatacaggcactttaataggcaagaagcagctgacatcaagcagtcagagcaggtaaaagaatagtaatagcataaaaagaggaataatattcttctctatacagaatttatcaaatcctgcagtagcatggctgctatgcccatctagaatcaataggtgatatctcccaactgtgtatggagctgtataggtctcaaaggtcttctgaagccatttaaggcctatctcattatttgtccagccattcttgctaatattgatttggtagtcctttgggatagcttaataccattgagattagtgattctctgctgcaagaataatatatggaggtaaggcctatccagctgcatttagtgcaataattgcagtaacccattcatgattcccaggctgtatagcttttgcataactctcttgtgtttctgatccacagataactttggcagttaaaatcacacctatttggaagccagtcttatccatattatagatatcttgcttgaggatctcatacttttgaatagtattatgaaactgcttgaaccaccccttaattagctctggatctttatattttgctcattaataatcatacttttgggtatatttagagcaacgctcattatggcacttaatgaattagttcacctatttctcaccaatggtggcagtagcatctaaggataatcatgcagagagcaatagctgtgccagaaaattcacagaggtaggctacatcagtctatattaagaatccattttgaaagtgtagtctcttcactatctattaatttttgataatttgccgttgaatctttgcaagaagtagtcctattaaggcatgtcctaagggtcctttaaggcacatcaaacacatctgcagctgccttttttgatgagaaaagacctttcttataggcctcaattgctaattgcatatgcccttcctttgatatatcagccatggcatggtgcattgaaaacaaatcgtatcgaatttgattagggggtggtagtggatgacatggcagctcggtgtccgattacattatataaataaaatatattatagtctaatatcactttatataggagaaataagaatagggagttattaatatctaatatattcttatagtagattatagatatcttaataaagcctttattaaaagacaatttaatgctctatacatagttacttagactaaaatagatatagtatattatagcctatcttgacctactttattattaactatagatatatatattattatatctaattgtccttatactttagctagcttttctcttaatagtagttagtaaataccttaattgaattataaatagtatttagctttaaataataatataatactcctattatatctataactaaattagatatatcctttaagatatcttactcttataactcttttcttacctttaatagatcttaagacttttacctttatactcttagattttttataataattctataggttaagcttattatatatttactctaagcttatatcctgtcctaataagtagtcaaagattagttagatgttagtactactagactataatagttataattacttcttaatactataggtagtacctaaataatattaggatacctagattatattctttagtatatagatgtaattatatataggagataaagagtagagagactatacttaatattactatattactatattaattaagtcctagaggggaagataataccttattatattaagtatatagaaaaaaaagggatagctaaggggattataatataattaagatataaattagactagataggattgctaccttgaatactccctatcataaatctaggagatagctctactaggtaatatactttttaaaaagtaagagatctaaagacaaaaagggtatatatacctagttaggtaattatagatctggtaagagtataataataagggtagaaagagagagtaaaagtttagaagaagtatcttactatctaagtaggagtaataaaatagatagagttagctagtcattaatctactagctaaaaggtcatataatagaagttatataattagaacctaaggcgggaatagaaaaaagaatatttttctaatagatgctaagactagtataaataggttagcagactcctatatagatagtttcctaatcaaccttttgcagctccaacacacaatataataccacataactgtagattttcgtcattataatacctttaataatactacctaaataggaatagtaaaagatagaattataatagatactagtaataacccaatactagtaaaggcctatactttaaaaatacctacctcctaaactataggtaagcctactagtaataacttaaatatacttaatctaagagtaagctaaagaaggataaggctagtaaagataataaggggatataataggctttaaagtactaacctttaactaaattataataacctaaggtactacttaattagtagggttaaaaatatattattaataagaatagcttatttaggtataagatattatttgagaggtacttattaagagagacagatattattatataaataggataaatttataaattctaaacctaaatttaagaatataactaaggcttttactaaatcttagttattcttatattatttatttttactatattaataattttaaaagccctcttaaaagtaatagctataggtaccttgagaattataaaagctttaaaaagtataggagcctaaattacttttaagactaatctaataataaagataagtttaatagctctaatatataatcttctaatataataatagattataagatagataatagctagactaacttattataattaattatttaaggatatccacttagaataatggttataacctacctcttagataagagagaggtaaagaaattaatttatatattaaagagaatattatttatatttaggctttagagcgctatttttatattataataggcctttagagataagggagtagtaaaaatataaaagcctaagagtttacttataaattagtaaggatattaatcctaagatatagtctatataatattataaattaagaccttagtatattaatattttatataactatagttcctggagtattatatatttataatatatataatttaagccttaatattattaaaaatgttagtaataccttattactgctctactaggttataataaataataagtaaattatctttaaggactttaagctttattatcctttataattattattaggatataaatatacctataaagagataaaggacttaattaacctagtaattgaataatacctcctcttcttattaggtataattatatataataaatataaatttagatctaactcttattagattattattaaccttatttagagtattatatagatcttaaagtaccttataacctataaaataagattagattaaaaaataataaaaagagattatatccttattgagataacctaaatttaacctaagacttatagagagacccttaattattaattataaagtatatttagagctaaataaactaagataccttccttaataataaaaagggttaaatagtacctatacttactaaagagtcctatagatataaataaagtagttaggtatataattataatatttattattataatagaagtagctattcttaagacctaggttactatatatttatacctaagatatactctagaaataataaaattataataaagggtttagtaggcttatagaaagactaaacttataaatataaataataattaagaggtatttaaaaagctatattataaattaagctataaaatagtaaaaataactagctaattattttaataaaggataaaagaggctatttaaatataagaaggctttttaaaagttaaaagataagctaggagtaagggcttatcttaacctatatttatatttactcttattaataaagataataataagattaatatgctagatagaaaggtatacctctttaaatagatattcttcccaccccttttagatactaatcttaaagatattaaaagattttaatagacctaattcttatattgaaaattatctaaggttagaaatattataaaagatattactctttataaggtactaggactaaataaaatattaaacctgatactaaagatattaaccttaattctagaggaataactaataaccctttttaatacttattcaagatattaatactatcttatttatttttaaaaatctattataattatcttttagaaactaagtaaagataattatatagaccctaaagcatataaatttattatactatttaatactttaagtaaggtttttaaaattataataattaattacttaataaaggaatactaccttagtaactatataggtagctaaagaacctaagtatataaatatattatttatatcttattaaaaaggatatatactacttagaaattagggtacctaataatatccttaccaatactaaatattttaggagcctttaataatatgttttatacatagctactatataatctaaggaaaaagtggatccttttatttataataagatagattaataacttcttttatagctatatgataattataactttttaaaaaggggagataagtaaatttataattaatataagtatcttttaagggtccttacttttattaatttttttctcttttataatattaatcttattaaagagctataataggctaatagtactataattataggctatattaataatatttatatcttaatatagggataaataataaaatctaattattaaaggcttaaagaactctataaggttattaaaaataagaattttaatatacctcctaattcactccctctcaatatagatttatttatatattttgaccttaatatagctttaaagctctataaactaacttagttttatttatttatatttatagggtttaaattaatactagacttataataagatatttaggagtttagctagactaaatacttttaagtataaagtatatctactatcttagggctaatatagttaaataaataattattttattactagatctatataaggtatatatataatataccttagaagatatacttattaattatccttcttaaaatcttttatatatatactctatttaatatatctaagtagggtatagttttaaaaaagctaaatataaagtatataagatactaaaattaatctaatattatacctttaagataattaattaatagtactttctatattatattttaaaaagcccttaaggtctatttataattcccctttttaaggtactttttagaagggtaattaattaaagatttatacctttatatcttaatattaagtttttataaggatattctagctataaggtataaaactagatatagttacattataatattatataaaagacctttttatactcttttttaagatattaaagtattaacttaagtccttattttaaagaattttagataatcttaaactaattaaaccttttactactccctaataggatttatttaatataaatatccctgaaaataaaaagtaagcctataagtattatttatagatactaagagaacctaatactttaatatatatataaatagtaataggttaaaaacgggtataagggctatagctaccttatatataaggataattaagttattaattatttatattattaaatttaaaggtattaatatagcctcagattaagtaatttaagtcgttacttaaaaaaactaatagatagcctatagattctttatataagattataatctttatagataactaaatagccttaaaatatattattagcctagctataacttaatctaatatatatttaagggtataatataaaagattaaccttctatattataaagataaataactaagctatagtaggtactaggttatataagtatattatgtaataaattagctaattaacgtatttcccggctgtttcgatcacccggttgctccgatcactagaatacccatacaaaatgcgtttttttgtacgctcataccacaatgtctatattatatcctggcctttaattttaaaatcagattatatataggtataactacttgtaagagaaatataaggttaatattatattatatatattgctttttagatacctatttttaatttacataaaaattacactgtattttatattattccagtaaataatagagtagactacttctgattaatgctgtatgctgtaaatactataattatagtatataaaatatctctttaatatcttataggaattatatataatgactagaagttctaatcaactatatataactctatagtgctatatttttcactataaaactgttgtgcagggaccagtgtggcgtggtgcggctggaaggtctatggcgcggcttccaccccttgcacgggtggtttgactgggctcccgtagcgggagggaaaacaaaaattttctttgccggctcacggggggttttggggtcttcccaactgacaacaaaggggtaatttgaaataaaaatctagtatgttattaagtttgatgagtagaacaaattggtgtcaaaatcgagttcgaatacccccaaattgggggggcgtgttgggagcgcgagagttgtatatctttattattatcctatttctagttaaattaatatttataacccttgtctatatttagtatctaatatatacttagaggtataaaaagtaaacttatactttaaaagcttttatttctaagcttttattcctaaattagaaagcttatctttaaattaaagagataaaattagcctataagataattaatatatatataatatatacttaagctctacttttatatatataagtataagaattttatattagttaataatcttaataatcttattagctaaatttatccctagttttattacaggaggaaaataataaatacaataaatattattaatgaaataaataaaaaataatcccaggcttaaggaacaaaatattaaattagatattatatttttaatattataccttatttaggcctaaataatagttaaatcttaataggcttatacttagtatatgttaaatataaattctattataggttagttttttataattatataaataatataagtatattagtcctaaaaaaaagatcttaaggctatatttattactgtttattgagatttataaataaggtatataaacctctattatatatagtataataaattaagctaaatattatagtttaaaatctaataataaaaaatagctaagataatacaactatatatttagtatatatttaataagtatataatatatacttactttattctacttaaataggactagatattaattataatatatctttttattaataattaaataaagatagtaactattataattctaattttagttttaaagaaatacctaatgaaacctaaaataaaattagtatatactaagtatagattagatataaatttaatataaataaggtagctatagactatattataaatatctttaatttattataaggttattatagattaactatagtctcaaataaaggtcttaaatatattattattaagtttaatattattatatacttaatattacttaagtaggctaaagtagatatatttataatactaaatattactgtatatataggcttagtaataggttttatatactatattattattatcttttattaatagtttagctaataatnttaaattatagtcttataaaagaaaactaaactaaaagtaatatttattagaagtttaatattattatatacttaatattacttaagtaggctaaagtagatatatttataatactaaaatattactgtatatataggcttagtaataggtttttatatactatattattattatctttttataatagttttagcctaataatcttaaaattactagtcttataaaaagaaaactaaacctaaaagtaatattttattagttaggtatagttaaggtatagattctagatatataatataggtaaatctataaagatagttatttaaatatctcttaaatattagaaaatatcttcttattagatagggaattttttatataaataaaatataaaaccccttttttatctattttaggatacttaaataaaagatagtctttaaccttataaactataatttataagtaattattactataaataataattctaaggtctaagattacatctatatatacttagtatatgctagatatatatatattatataccttattaaagcctatttaaagaggtactttatacttaggttctaggtctaagtctaaaagtaactaaatttaggatttattgttactatttatattagggttgttacttttactagctttattatctttattattatctatatattattagctatatatacttagtatatacttagataaataaattatataaaaggttataaaataattaaaactttatttgtttcttattatattattttagtagaattaataaagaaatatagagtaataataggaagaactaagtctaatttttataaagtatataaatatttataaataaaaaagatactagtataaagctactatatatatgcccttattataccctaactaagcttaatatatactaggcagacaagctctagccaggctaaacttttctagctaggcccaacttttttatagctaggcttatatataagcttatttattataagacttgagattagggttaatataaataataattattttttaagcttctaccttagatatcctaatagatattagagctagatagcttctttaatagcttatatatcctttatatatttagcttcatataacaataaggctataaagctttattattttaataactaatgatattattctttaaatatagcctaagttaaatattatatagggacctctcctacctaatttatatctatatatctaatatatccctattagaagagtttaataatatagttctttttattattatatataatagctttctctaaatagtggttatatagccctaaattaactatataaaaatatttattaaaaaatcttttttagatttctttaattaatagcctaaaaattaataagttattaatatagtaatatatattaggtcctaataaaagtacttaatggagattagcttaaataatatttttaaaaaatatttaatataaagtactaaatttttagtaattactttaggctatatagtactttatctagtttataaacctaacttatattatttagtcctattaattatttaatataaaccttattattaatattattatacaagaaaactattttaatatttaatttttaaatctaacatagctataatagtaaataaggctttatatttattagtttaataattaatataaaagttttattataattaattctctctttttattttttatttaaagcctttaatatttttcgccttaaaccttaggattcttttattaaatttttattgaattttatatacctatttcccttttaatacctttttccctagaggtatattaactagagtctaagtctaatttttatgtaataattttttattatttttagctttttttttagtttagatcttcctaagcctctttaaatatagtaaagtaaatagagtcagccagttactaatctgctggttaagaggtcatataattataaagttatatagctaaagcctaaggcaggaataaaaggaagaatatttttctaatagatattaagattagtataaataggctagcagacttatatagatagttttctaattaaccttctctaacgctttatatgtaatatgttattatataattatagatttttactaggttataagcctaggtaggctttataattataaataaatattttcctactaatactaaatattataagttaacttaaaatactactactaatctatttataaggagataattaaacccctaaaccagtattatagaatattaaagaaaactttatttaagatagctactttataatttaaagtagatatgagtcaattattttatttctttagctactaaattttttacctataaagataactagagattaagatataaatattacctatttactcttaaatataaacttatcattctttatatattaattattctaacttattattatatattttttaaacctaaattgctttctctctatttaactatatttatctaaatatttataatagagttaaggttaagctttttagatctaacaaaggatacttagtaaatccttttatcgctattattagatataattattaatttaatactattaatattacccttaataatctatttggctttaaagtttggatactttttaaaataatataataaaatgtagatataactaatttagaattagaatatatctactctttagatttaaattatttaagttaataaatattaataaagattaatagtaaaaataataatacttaataaaaatataaggtctagcctctatattaatcttttaaattaagttatagctaaaaaaataaaaataaaatatatctaattatttagagattaataagtataaagatctcttttatagatatattaaagccttaactagagattaaaaagagtctaaaaaagagtataataaagaagaaaaataaaataaagaaatagaaataagcttatactataatataaagctatctaagcctaaatataagagatattattattaataaggtcaaaataataaaaaagatttttaataaactaaagatttcctactacttataaagatataattatttttaaatattaatataagaactaaaataacttatactaaataattataaaaatattataaagtatactaagtaaagaaatttaccctaattataatatattagaggcttattaagttaatacctttcttaataaattaagactatagccttattctaaaatagaagcctttaggataaaactaattatataggtataaccttagccttattattaattttaactttaagcttaaccttaatattagcctttattttaataaaactcacctttaataaaattattatagtagctagtataaaagaaagtttaaaaatataaattaaaatatattaagttttaataaaaagaaagactaagattagattaataataatagttatctattataactattattagtactttctttatattaaactattaggaggtataccctaaattaaaaaaatataattaaaaagggagactataaatatttaaaaaggaattaagctaaaataaacctaattaaattaaagttaaaaatgatctttatagctacttttttaaagttttataataattttatgaaacttctttataattaatactgaagttatttagtatattcattataagcttaattactttaattactctatttttagaccttaattaataaagattttataagacttaataactctatttaaagctagtcttaaaaaatataatataaatcttttacaaggttaagggtattaaagctattttaaagctctaaaatatcttttattacttaaatattagtataaatcttattttagtattatagagtatagataaaggagtagaaatctatattctaagggattatatagagattttattacttaattaattattttaatttattatacccctttataatagaatatatctcttaaagttttagaagtattagttaaacctatattacttaattatataattaagaaccttaaattataaatctagtattaataacttagttatttaattaaagggaatattaaactattatacaagatattaattaatattaacctattattacttacctatatcttctttatattaaaaggtatataaaaaaggatctttatagatataaaacgaaataaagtatttaccctcttaagcttatttatattaatatttatagcccttttttaattaattaaaggttataataacttttagtactagattatttttttaataactttatttaataagtgaaaattatatttattaataaaagagtaacctctttaaagagttttaatactttctagtatataataaatattttagtattattattattaaatctatcttaataatataaaggagaataataataaagaatttataaataaatataattaatgaattatttcaaaacactttacccttaattaatataaatagagtagtactattaggttacttaattatattattattataaataagctctatcctataattattaatactaggcttaaattaaaatagtaactacctttaaggtactttatattattatttactatataactaatctttaagcttaattattagtaaaaccctatataaagcttagtataaaaagaaactagacttaaacttactaatattataatattaatatataagcttctaacatataaagggattatatttattatctctttacccctaataataaggttatctaatctttaaatatctatttttataaagaatagccttatttactaaatttagatattctaaaacctttataaataattataggctactattaaaagggaggattatctagttaataaaacttataagatataaagattaaacctcttatttttataaagaaaactattagattagctaatagtatctataaattgtagcatgcgggacacagataccctgtgtgggttgtgcgaagatctggagatgacaatgatattgttgatgtcaagtaactacagaactagctaagataaagtaataacaaactatatgcagtaagaattagcagaatactagagtagcataatattatcccccctttttttaaaaaaaagatgtctttatctatattaatatatatagagagtctataaaaggtctaagaatataaaatgatataaaaaacataaaataatataaaaggtgtagagaatctataagaaaattaagaacctttattagtaataagatcctctaaggtacacttagcatatgctaattacaggttatatttaatattagtatataatagacttaagtatataagtagagagataatatctatatagcaggcagcttatatatagttttaatagaaaagctatatagctaggtgacttaagaataatactctaatataatataaaacttagtctatttagataattactatttatatccctattattagagatgctaataatatttattactcttatatatagtaatattataataataagtagcagtagaataactaattaagtctaatatatccttaataaagccttccctaaaatatactattaaagtatgtagataacctctaaagctatatagtaataacctatatacatactaatattattaatagtagctcttaggaaagtaagctattagtctttaatagtatttttttataatttaatataatatatttttaaaggtatatcctattagtactataaggtagtattatatagtagataccttttaaggcactaaaggagggagggataattagaaagataatagacattctaataaaactataaattaatactaatattatataaagtattttcccaaatccaaaatattattatattaattatagaagtagttattaagtatctataggttaaataattagaacctaggtatcttagatatcttagataaatattaactagattatctctgatttatcttaaaaatatctgctgctagagctatatagtattagcttagttttactaatagtagagtctaaaaaggcctttgtaactttagctatataaagattaagcttttattttttattctgattattattaggagatctatagaacatttaatgctagttagtaacattattatagatagtaattacaatactattaatagtaaagatattagagatattattattagataggtccagtattctataggcagcataagaggagataatggaggtaaaggtaataacttactattatatattagagaggaagaatactgaggtggtggcagtagtatagatattagtaataaggaatgctgaattgttggtaatggtgaggagattggttcctgttgcatagaggttgatggctgttgagctgcaggctttccgggtcgtttctgttgttgcgtagattgcagaagccgggcagtgcagcgccttcccaatgtggaagtcggttggttgcctagttgtggtgacatcaccacttgccaatcaaggaatcctcataatagaggttctgtcagattaagaaatttttggacagcctcgtgcagaattaggtgagaaattggccagtcaactaggtaagataatagtttttaatggggaatcctgactgagttcttagggcttataatggaggcaccagagtataaaaggataaggttaataggtctagttacaggtagaaagtaaagatatagttaatataattatgatattattaaacttagcagtataggaatataataggttatttgcttagaatcctgctaactagaagcccaatttaatagctctagttagcagggtaattatattagcaagaaatctattataatcaattagattatctattggtaaagactacaagtatatataggaaaaggatataggtacctactaatagttaccctgttaaaaacatagctatagagggagaaaagagctcaaacctaggtctcagagatcaaacctagatatgctaccaaattatagcatatagaatatagatacactataggttatataatgatctagataataatattattgatgtcaactaactacagaactagctaagatgaagtaataacaaactataggcagtgaggattggcagaatgccggagcggcataacataaatagtctaaagaataatagttctagtactatctaaggagataataatcctaatagtactaaatctataaaagataatagttctataaaaaatatactataaacattatttaatataatataagaagaacctattaataatatacctttattactaaaccctttaaataaattaatacttaatataatatatttaattagtaatttaataataatcttttaaactctttactagttttagctataataattaaactagttaaaatatttaaccctaaaacttttaaagaggtataggaggatttaaattattactaaagaattaaacctagaccttaattaaagtacctttaagaagaaaggtactaaaaagaaaataaatatataagattaaataagggctaaataagaaactcttaaggtttaaggctgaataggtagttaagggctttaaataaaagaaaaaaaatgattataataaaatatttatattaattattaaattaataagctataaggctttatttattattatagctatattagattaagaaattaaataaataaatattaaaatagctttttatatagtaatattaataaaatctatattaaataattaatagatctagaagataagactagttaggtatataaacttaataaggctttatatagattaaagtagttattaaagatttagtattttacattaaataatttctcaaaaaaatgattttaaactaatcttaatagacaagcatttttattagaacctaatatatattactatttatattaataatttattaatctttagattattaattataaagatttaaaaagttaaaaagcctttagtaaataattctatataaataacctaagcctttataattattatttgaaaataactattatataataaaaagaattatattatctaactctcctaataagaatatattaagaaagtattttataaatttagaatataagactataaactagttattatattaatagatctaaatataaaattaaaggatatgactagataaaataaataactctaatttaataacctaatgtacttactattagatccttcatatatatatatatatataatattaggaatatatatagatcttatatatactatattaatattcaattattttatacctaagcttaatataacctactttgaagtaataaaataagtcttttattatcttaaagggattcttaatcttatttttatttataaaagggagttatatcccctttataaatatataaatataaactaggtaaaagaggtttttatttaatattctatcttaaattatatttttaatttaagaaatagtataattagctagttattaaaataataaacctctataatattattatcttataaagtagaatatataaataaaatagaaactactaaagaagctagttagctctaatagctattaagttatcttaaataaaagcttaaaggagtaataattatttatattatttatattaatcttaacttaggctcttataaacttatacctaaattaataaccttataataattaaggtactataatactaatgaagaacctaaatattctctataagaataaactctattataatataatactattttatataggagaaataagaaaagggtatttaatatttagtttataaatgattaaataataaatattttaatatgttattattaagagattactttctaaagctctaaactatatttagattaaaataaatatagtatatttagcttattttaacttatttactattaaagcctcttacttaattttcttctttaacattacttaataaataccttagttaacctataagtattaattatatataaataataatataatcctccttttatacctttaattaagttaaatatatcttttaaggtatttttatttttataatttttttcttccttttaattaatttagagacttatacctaaaccttgagaattgttttattaattttaaaggctaggcctatcatatatctatcttaacctaatctctttttttaataagtatttaaaagttagctagatctttatactactagactataataattataattatttttagtactataggctatacctaaatagtaacaagatatttagcttatactctttaatatataaacttaaatatatataggagatgaagaataaagaaattatatttaatattattaggctattaccttaattaagtcttaaaaaggaggataatatttagttatctaagactataatttatacttaataattattaataagaggtaggaataaataaagaatatcctcctcctaacctaatagaagtttattaaatatataaaaaagacaaaaaaagggtatagtataattaagatataaattaaataaaataagattattaccttaaatactccttatcctagatttagaagacagtattactagataatatatttttttaaaaaagtaagagatctaaggataaaaaagtatatatatttaactaaaaaaataattatagttaaataagagtataataatagaaatataataagagtttaaaaatagtattttgctaattatctaaataagagtaataaaatagatatagtaatctactagttaagaggttatataattatagttatatagctagagcctaaggtaggaataaaaaaagaatatttttctaatagatattaagattagtataaataggctagtagacttttttatagatagttttctaattaatcttttcctaactgtatatataatatactattatataactatagatttatgccaaaatatctttaaatattttaactagtttaactattataataagaaattaatagagagttcataggactattaagttattaatgagatattatatattaaagactggtttatttaagagatttaataataaaggagggttatttataaagttaactaaaactttattaaggagtatcgttattaggtttttataaaattattattttttatagattattattattattattattatctccttatataatattaaattattttatattatctataaatattattagctaatctagtagtttctttataactaagagttatttatatatgtaagccttatatcttataggtcttattatctaaataatctttccttctaataatagcttataattacttttaagggtactcttaaaatattagaatctagtatatagtatataagactattccttttaaaaataaatatttaaggattaaataatctagttattaagagttgggagatagtaaacataattacttatattttaagagttcatatatgatagcctttgtctataagcttcctatattttttctaatcttttaaaggtatactagatctggttttctattatattaagccttatatagggtcttctttataacttatatttaagaattagttatataaatagatgatgatatagggtaattctagctattactttagatctaacctagtactaataaatatagggcagagtttatttataataacctagtttaataatagtattatttatataagttaaggattaagggttttaaaatctttattaattataacatttatttataaatttattattagtattttctctaaccttattacaataaacatagtaataataatatttaaggtatttattttatattaaaaaatattagaatttattaaaaaaattaacttttttattaataaatataacctctatttattaggtaaagttattatatttaattttatatttataagggtccattttttatttattctttaatataaagaaggtataggtatccctttaaaagggggttataactaattaatatcttatgtagttatttaatacttttatttaagtaaataagataataatattagacctctaacttaaggtttttaattgtatagctaagtaatatatcttattataaagagatattataaattataataattaattaaaagaatcttaatataatcttttaagatctaaatttataccctttttaagtaatttataatattaaaataaggttggtttattttaatcttaagataataaaagatattttaaagttttaagattatttttacccctttttgaccttataaaagatttatattatactttttaagttagtctaaggtataagtccctaatttttataagatctttattaatataactcttaaataaagagtaattaaaatacttaatgttataataaatatattatataaccttaatattaattataaaaatatctataaaattataaagctttaaaaatattattataaaggttacctttaattctagtttgattaggtttatttttgcttaatttctttttaaatatcgtctctttttttattgtatattttttagctttagatataattcctaataattattcttagtataaaaaaactactaataataattataatagggaataattataattaacgttttaatcttagcttttcttttaataaaaaagcttaatagatttttaatttatattcttaaataaattttcctctatacttactataactataaccttattaagagtaagctttattaaggttaaagttatagtaaaaaaataagatatagtatctaatttattcaatttattttatagtattttaaaatagagtagtttaaagaatacataatctagtcctagcctattaaagaaggtattaacttaataagcttctaacatattatagtctaaatagatttctgataatttattatagattcttttagtttattttatatagtttataatctctttataattatttaaaatatgctactttaactcgtatattaaggtttaaaaatagttatatctttaggggtaataatagattactagcttattaaagattttctttactatattaagtctatctataatatctcctatatttaagcttagctagctttatattataatctaaatatttctctatttttttttactttttcttccttattataaaatctttttttagcttgttttattccctaattagagcttaggtatatataaaaaagatccctataatatattaatcttaaggtaattagtatatcttttttgtattctatctatttataattcaactctaggattagtattaagtaagccttatatactcttattagttattattattattactattgctattaattcttattagctcttaataatataataagcttagattaagggataaaagattataatctagtcttataaagcttaaatctaagtcttattaagtatttttaagggatatttagattttaaagctaaacaggttatttagtaataatattaataatattaagttaataataatattaaataatgagattaatagatagtatttaatatttttaatattagatctaaataattctactcctctataagtattaaggtaaatataaataaagggaaaataattagatctaggaaataaggtatattagttaaaataattattttctaatatagtaataagtctatatttagattactatagtaatagaaaattaagtaatatttatgccttagttctattaggcttatagttaagaaaaattagtaattaaaaaagtaaaaaataagatagctagaggagctaaatataatcaaccttatactcggtcgacgagctctcacctctacgtggtaactgagactagtagtccttacaaagctgatgaaactaagaggagctcacattctttttctgggagttttttgggccagatttattgaagttttgacctattctactcttatgaaaaattttcactacctgctgaccacctgcctattatcgatatctgaccccaatatcgagcaattaccaaatcaaacacctagatatatataaaatatatatatctagagcctacctgcctgcctagggaacaggaaggggcctagggaaggagggttttccatatttaccttctcccctactcggacttcccctttgacccaaccggctgaccaactacctgcttactatcgatttctgccccctaaattaagtgaccactattgtcgaatatctagatatctatatctagagcctacattaggctatattcaacatatagcctctaccatctagccagactaccattcgttgacttgtgatttatttgtttcctaccacctgcttacctatctttttatttcctacttttccccactaggttgagcttatataagctccctaaccaatcagccctaccaattggcctcaggccatctaccattcagcccctcttagaaggataccacagatgactggactatagcctaaccaatttctgcatgtatttagtcactcgctactaagtcctattattgcttaggtaataggcagaccgtgcatagtctttgactgaaaaacggtctctaaaatggaagaataataataataatcaactggctgaccaactacctgcttactatcaatttctgccccctaaattaagtgaccactattgtcgaatatctagatatatatatctagagcctacattaggctatattcaacatatagcctctaccatctagccagactaccattcgttgacttgtgatttatttgtttcctaccacctgcttacctatcttttatttcctacttttccccactaggttgagcttatataagctccctaaccaatcagccctaccaattggcctcaggccatctaccattcagcccctcttagaaggataccacagatgactggactatagcctaaccaatttctgcatgtatttagtcactcgctactaagtcctattattgcttaggtaataggcagaccgtgcatagtctttgactgaaaaacggtctctaaaatggaagaagaataataataatcataattattaaaggcttttttaatttttagatttttataattaatagtctaaaagggaatacattattaatataaataataatatatatattaagtcataataaaagattcttagatttataaagactaattaaagccttatatttctaagaaaatatttaatgtaaaatattaaattcttaataactattttagcttatataatattttattaagtttataaacttagtttatattatttttaagcccttaataattatttaatataaatttttattatcaatattgtgagagagaagacgtctatgcagaagatgatgttgttgagattactccttattctttacatacctctttattagtagattattaaaataatactactaatatactacctttatcctctttagaataacctccttttattataataatatctataacttatataatattactatatatatttctagtattatattagtatctagatagtataataaaacctaggagtagcctatagtcttaggagcttaaaaataacttaagtttctcttttaagcctttattaataaacctttttaaggtactataattaataattttatagatatcctcctttataaataattaaattagtttaattatttcctaccttattaatataatagtaccctattatatttatttatatataagaactactagctaaactataatctaatatagaaccccttaccccccatataaggattattagttaattacttatagtaaggttactacccttagaattatataatttagactccttcgggactactatagagttattaataataccttagaccttagatagggaattatatattattatatagccctttataaaacaggctactatatttataattaatataataaccctacctaagatagttctagccttatatagggtaacctttatagctattatataatataaacccctaattattatagttattttaatagcctaatttataactataaccctttaactaatagcttatatcaataatactaataatattcttaataaatatatataaagacaaattatactaggcctatgaggagtattaccccctaaatagatataataatatatatataatagtataaattataatattaagaattatatttctaaaccctctaacttagagtttattaatagttagtatacttatacttattaggtttgcccttttatagtaccctttaataattaattatataattattaaaagtactatagtaatactatatatagtgtaggctattataatactaattatattaaccttaatagcttatacctactattaatatctaatattaaggttaatactttttaaagatagtaatatagctattataactttattaacttataatagaccttataaactaatttatttagatataggctatataataaccctaattaattagtaattcctatataataagaccctaatattattatttaaactaaatagtctactttaaatctatagtattaatattataatatataatattaaagaatttataaaaatctctatttttatccttatattactaaatagtacccttattaatattaagatactatataaagcttattatagaattactctatattaatatatttataagaattaataccttaggaccttatagtattattattaataggattaaatctatagcttttattagtacctataaagatactaagattaaactatatataaatagtaagcctattaataatatatcttatctagtttattatcagtagtatattattttccccttttttagctaagctagactattaattaagattcttatttaataaaaatttcctttttaaaccatataaaattatactttatacctatataattaatattaatttcttatttatataagtatatactctctttaattaccttatagtatattataaaaaatttttcttagtatcctctctaactttaattatattaagatatatattataatagcagatactactaaactagtataaactaaataagataacctattacttatctactttaactataataaccctagtaataaataaatagcttcctaataatattattatattagtaataaagaagctatttattagtttactaatattattgatagatataatatctaaataaattataaaagatttattaatatctctaaagattaataatagataaagatcctattaattaagggatagtaatctaaaattataggacttaagcttggatatatttacccctttagcttaaaggattatacttgtataacttaataaaatatttaataataatactagctaacatttctattttattaatttacctttctattagttcttaaatactataatattattactattttatatcatatagcctctttaatataatagataaaaacttagatacttataatactaattagaattataatagataatataatactaaaatcttataaatatataataaagtaataagctaggataaaggcattcttataagtctaaaaagaccttagtaaccctataaacctataagttgtatatactattattaactatactagtatataactaaaagtaaatatagtatggccttataataatatgactagttataaataatttatataataagcctttaaataatttacttaagccagtactatatataataagaaattttaggtttaaataagatattacggctatagatagtagtaataaaaacttaagagtatactatctatctaagatagccttatagtaaaaccgctataataattattaatagtaactataatatagtaatctcaaagtcagttattaatagtactatagaagctactactattatattataggataactactctaacctaatatattttactactagccctattaataatattcttaataatattcttattaacctcaactctaagaactaataataacaaagtattagatagagatgctgcttaaacccctatggctttactataagtctccccttattgcatattttaaaatcaaaaaaaatcattaaaaaaacaagaatataggtttgcagcaaggatgcactttttttcaaaaaagggggcataatatcagccggttactagtatctcactaaccttgggcacctatatctagtaaccatcaggtagtctactactagtaatatttgtttaattaattatgaggttataatattaggaaattaagggagtaaataagttattagtagttattattttaaaaaaggtttttagctataaaggtaagggtagagtagtttattatagcttcttagttttctttttatctagaggggtagtaagtttataataatcttatagtaatattataacttattaatcttagataagagcctcctaaaatagttttttaatatagctatagaattcgtagatagcttcatataaaactaagatataagctaatctataagatataaaagtaattattagatagctttattagtcctagttaataatactattaggatatctatatataaagataatctaataaggggtagttaaggaaaatatatatagaaatccttaataaaattaataatatctaatataaagtctataatatagggttataatagatttattatataaaaagtagtaagttacaaggctaatttaattcctttaataaggaaaatattagtatacattagtctttatcaaaggggttaaatattatagttagtataaagataggcttatctatataagtagtattaataattaattagaagttatagtaaatagcacttaaggcatttattatatattaaaaatattgtattttttattaattttatctactaaaattaataaaaaatactttttaaaggtttaatatttttaactaggaaaagactagaaatattactataaataagtttaaaaggtaaataccttattttatatttaatgggcttttctatatatcttttatttaatataaagaagatataggtaataaataggaaataaattaatattaatattaatatattttataagtatttaattatttatttaaataaaatactaatattagatttaaaattttaatttttaattaaataattaaataataataatttaatatttcttaagaggtctaaaggatatattttattataaaaagtaattgaaagaaattcctttttttataatttataatattagaaataagaattatattaatattagaatcataaaaaatattatttttatacccttaattttatacagaatctatattatacttttttaaactagctctaaatataaatctttaatctttatatgattattattataagttttaagaataaagtaattaaaacattaaaacttataataaatatattaaataattttaatatgattataaaatatccataaaattattataagattttgaaagtattataaatattatttttaattttagttttattaagtttatattagcttaattcctttttaaatatttatagacctttttttattatatcttttttattataaaatataattgttaataactacttttaatataaaatattaataataatttttattaagtttaatattaagggtaatgttaaaattatatttaaataattaaatttattttataggattctatttaagaataaaactattttaaataaacttaatatattataattgaagtaaatttattataatttattatagatccttttaatttatttaaatatctttatgataatttaagttctttagttcttatatgaaggcctaaaattagttatatctttataaagaataataaattttaatatattactttttaaaaaatataagtaaccttattaatagtaccttttatatataataatagctttatattataatatatatttattttgtttactatttatagatagctattatattttatatagactattgatataattttataaataaggttatttataactattatttatatagttttttataacatttaattacataataattatataatccatgtaagttaggtaaaaattatatatttttatatagcttttttttatatattttttcataaactttactataagctttttataagtttcttataaatttctttataagctgttttataagattttttattagatttctataatattctctagcctataggccttacctataagatagtaaactctataactatctatctactcctttctactttcgtttatatatatagtatagatagcttcctaggggtaatgcctagtacatatggtagctgacttactgcctgatatgacctgccagcacttggcccttggctgatagatctgagtatgaataaatcaatcaatcaatcaattatataataaaacttgtaatatagtttctaatatattatataaataaaagccttataaattttttattataattatttaattaatttaattactttattaaaaaatattatttataaagtaataatttttatataagatataaattatttattttcaataataaacaagtttataatactaaatattattatatttataggcttaataataggttatatattttatactaatatctaaattaaatagaaggaatactttagagctctaggatagcctcagtacccttaatcttataaaaatctatatatatctttctagactagctttaaataaagtttattaagtcttataagatctttattaatataaggcctaaaggtaaaataattaaaataattaagcttataataaatatattagatagctttaatattaattataaagatattaataaaattattataaaagtttaaaaaaggctattataaaggttaccttaattttagtttaattaggtctattttagtttaatttctttttaaatatttagtctcccctcttagttatatccctttttaatttaaggtataactcttagtagttatttttaatgtaaaaaaaatactagtaatagttaaataagaagaaactattattattaacctttttaatcttaacttttccctttattaaaaagccttatatattttattctaatttatatttttaacctactcttttctatattagctattataataaattattattaaaaataagttttattaaggtagaggctagtattaagattaagcttaaaaattaaagttaaggttgaggctaaggttatacttatataattagtcttatcttagaggattctattttttagaataaggctattttaaagaatatataatctaaccctagtttattaaagaaggtattaacccaataagcctctaatatattataattagggtaaatttcttataatttattataaatccttttaattcctatattaataatatttagaaataattatatccctataggtaataatatatttctaatttattaaagatcttttttactattttaaccttattaataatatctcttatatttaggcttaggtaattttatattataatataggtttacctctatttctttttgtattctctcccttattataaactcttttttagactccttttaatctgtagttaaggctttaatatatttataaaaaaaatccccatatttattaatctctaggtagttagatatattttatttctactttatctagttataacttaatttaaagattagtatagaggctagatcttatatactcttattagatattattacttttactattaatgactattttaaacaatatataatataggttaaggggagttactattctcttatagaatattaacaattatagattagtataagttagagccatttaaataagggtaatatataaataatagtatatatagtataaattaatattaaggttctctataatatccctatataaaatagcctagttagggaggtaaaataaagtattagggataatatagacctttctaggtttataaaatatatagagcctaaattattatatatgctaggatacttagatatgccataggtttagcttatctattaataatataattaaagaggtttacttagtaatcttaactatagctaaatagtctatatagataataatagccttagaataggactatattatatactaaagcttctttagtatctagataaggtaggtaacttctagcttagttagctagtaattctatttagccttccttagcctatagctaaagaatataattaattacctataatagatataagagggatagcaggattataacgtatagtattaaaaatatctatattatgctttatatagaaaactataatactaaagctatagtatttagaggcattaatattaatataaagttaatattaaatattatagtatactaatatagttaaggaaaatagctctagagaatatagaaagattctatagaggcttagcctataatagtacctatataagaatatataagaagtataagattaatatgctttagataatctatagaaggccttaagtagtattattttatactattagagtagtttggcttttatagcataatatatattaatagagctaactagttatactaaggtaggttttaaggttagagagggactataagaattctaaccttaagatagccttaagtttatctttaggggtagtaagcctaagggaagaaatatattaccctaatatcttaactaataaaaaacttaggaaggtcttatataggttaagtttaggttaatctaattataatatataaaaaatttaattaagatggttaagatagataactaataaagctatataaaaagaataaagttattaatatagttatagaaaaagtgtttcttatcctagaattattattaacttagtattatatatatactctattattaataaagcctataacttttaatacctagcctctatataaaattactataaggaactcatcaaaattaagatatatttataactaataaaaaaataaaatagtatctataactagtatataattatatttagctaaggtagtaataatatctttttaagccataattggataaatattaggttaagtaattatattcaatcactagatattaataatagtataacctttatatttaactttcctatccttaatggattctttctatataataaaaataggatactctaaaggtatatagttcttagcctattctatttatccaaataaataaagcttattaaaaattttattaataacctccttatcctaagggctaagtagatcgatctagatttgcccttaatataatactcttagttcttaataagggaattataagctattcttttataaagaggttaagaaatctactattattaatctaaatttttaaataatgattagtaactttagtaatttagttaactatatctagggaactatatataataaggctattaaagagctttatgtcaagatataaagggactttattaaggataagttgtaggaaaactaacttatttaataaaggttacttagctaaggatactatagatagattaatataaaaggtatctattatattatacttagataataggctaagataggctaagataagtatactaaggaatagtagctagagtattagtattattaatagtataaataaaagagaagttagtattaataatatatataaatagggtaaggtttagataaggattaggttaaaaaagataatcctaatctgctataagctaataggaatgcttctaataaattaggatccttatacaagaatatggtagaatgactacctattgcttagtataaataggttatacttagtagtagtaattagatttaggagtaatagtaaggttaatctatatatcataagagctgataacggtgaggtaatggtggacatcaatagtcaccctttcagggcccaaggtattaatgccaaggagcaaatttgcctgaagtcagtgatgtgtgattcctcgaggtaagccatagtggaaatgtattgcatatgtgaaatccaagcccagacttgccagtgatagagggagcctgagaagtaaataatattaaggttgtctaggttaatatagtatatagaaagactacagttgctagaacaaagaggtaagtataaagtatattatttgataggaactctatataataattagtataattaatagagttagtatagttatacagggtataactatactaagtttttaggggatctatacctaggttagtaatagactaatccctattatctatataaataatattattaagataatggaggttattaaagagtatattatcaaataacttagggaactctttaaagaacttattatataattctatagttaatagttactaggtattaggctagaataattataattattagatagtaaacctaaccttctttctttttagataattattaaagattaaaaataaggtataataatcttataaactatttataggctattattactttaaaatattaagggttctaaattattaaaataatttgaattaataaaaaaagttaattataattattataggtattattttattatttttcataagtaaaattatgaaataacttcggtaccttaaaattataataataattattagatatattagtctctaaaaagaaaataattaaattaatttaattactttttttataaaggtttctaagaattaaataactataatattcctatctagtttatttataatataataaaagggaagatctagcctttattaggtagctaaaataagatgaatatttatataataaaaatagacttatttaatagtagtaattattaataaaatatataatataatagacatttataactaggtatccttaattatatattatataaaattactaaggcttatttaagtaataattagaattatttctttggtttataatattaatcctttataaaattattataaataagcttttaataaataatattaaagagcttaatattctattaatattctattttaccttagaaataggtattaaggttttataatattttagtcatatcttataattatatagctatatataggtaattagtaaatatatatatagatattcttataataaatcttattatctttattaataatattacttataccttatttaaaaggtatattaaggtaaaaaaggctaatattatatattaataaaataaaaatagttaataatataagagcttttaaaaatatttataatattaaactaattatttagttaataattagaattctagtttaggtcttactaaggagataaatttaataaaaaagctatagtttattaaactactattattataagagcttaaagagttattagttattatagagtacaggtattattattatataagatattttttaatctatactaatctataatataatggttattaagaagatttatataactaataacttaatatataacttattatataaagagatatataattagatatagttattaatactataagaagctataatagcaggaaacaaattaatagaattagaaaataaaagatctttaagggaactattaattagttaaaaactaaatattaaagaattaaagttctatcctatatataatagcttaataaaaggaactagtatttataaaggggaagagaattataaaagggaataaggtatattatttatagtagagaatctataaaatataaatactcttaaggtatttaaaaataatattatttaatataaaagagttaaaaaaggagaataaaataaagaataaaataattattaataattataaggttctagaaataataaaatagaaagagataaaaaagaggaggataacttatataaaataagctaattaagaggctaatttataggataggtaaagggtataataaaataactagattaagtcttaaaagctaataatataaatataagaatatagaataaagaggcaggtaggtctagctaagaataaaatatatagatattttaatataattaaccatatctaaattaaaatctataatatatataaatatagtaggttaaacctaatataaagctagttaaaggaaaaagaataaggcttatttatataactaatataactagaagagtaagatatagatacctattaatagtaatcttactataaatataactatagagggagaaaagagcttaaacctaagtcttagagattaaacctgaatatactataaattagagtatatagaatataaatactttatagattatataataatttagagataataatattattattattaatattaactataaaactatctaagaaagtaataatagagtataggcagtaagaaccagcagaatgccagagcagcataacatattaagttagaggtattaatataaaatatattactataagatctcatttataggataaaaatattaaggaagtatattataggcttaaaaggcttaaaaaagaatagagatatttaataaatactataattataacggatattattagatagaggtagacttattttagtatataatattaagctagaaatatcttactttataaagctttagttttattagtttagtcctttttatatttataaagtttttaataatagtatataccttctaaaagatctagataatatacccttttaaaggcatatttatagtttaaggataaaggcatattttctaagagaacttaaggaagggattaataagatagagtatatacttattatagataaggaagatactattaatacttttaatattatagatataagagataataataaaaaggctacataggagttccctaatattaagatagtagtacctctactacccttaaactttattaataaactaactagacagggttatctagttttttaaggggagaaagggggtataaagtagtatagataagtagtatagatattaataataatagaagcttactagattaggtaaacttaaggttctatagggacattataggactattatagtaatatataaaggctataataactttaaggagctaattaaagaaattttatttgataaataaaaggactaatagtaagtaatatagtatataattaaaaagagttttctatttattttagaaatataaacgatactgactaaggggtaataattagagcttctttaaagataatatatttatctttaatatggtatttatactagactattactttcttttctttataataaactattctctttttttaatctttcttattttccccttacttctatattaaccttcttacccttagtttatatttatctaaagatacttattttatcttaagaatagtctaatattattatacacttaaaaagagtaaggggttatatctaaaaagaggctctttaatagagatctactagactataacaataggctataaatattactactaaataagctatatctaagacttaaagaaaataattataataagttatataagatactatataacctactataaggagagatagtattaatattgtagtattaaacctattattactagctttagctaaagtctctaaaatataaaaagagattataaaattggcttgagaatataatattaataagaataggagaaaaagaaccccgtataagaatctagaatataatataagtatctagttctaacttaagggaaggtgttattaggaatattttagttttacttagatacttattaataaactagtagtataaactcttatttaaaaaagaaatagctatattaattttaataataatatagtaataatagtctagatatagatatagtataataatactcttattaattaatttatagagtttattaagaaatttagggattataaataattaaaggtagaagaagatataaagctataagagctacttaaaagagctataaaataaataaaagaaaataggaaaggtataaaaaggaattaagaatatattaaaatagtttaaaataaggatatcttcctatgattataatagatattaactagttaaagcttattattattaagttttaattaactattatccttaataagagaaggtaagagaggctatattaactaattaattattaagtatcttataatacttaaataaggtagttaacttcttctttggccctttataattaatataaaaagagtaaaggattaggctaaagataaattaaagctttaataaaagaggaataagtaagtttagttcagaaaaataaatttagatttattatacctcttaatttatagatagttctaaattatatactaaagggtttgaagacttattattaaaaaagagtaaatagccttagtttttataacctaaatatagaagaggttatttatataagatccttgtataagttaggacctagaaggtctactcttatatagtatttaatatatattattaaataaagagtataatcttagagaggtaataaaagtttagaatagtaaataattagagtaaaatagaccctaaaaagatattagaagaaaataacaataattataattagagtacatttatattagaaaaatttaaataaaactattatattaaatagatataaggagttactctttataattatagctagttctcttaaataaatagctataaacctttttagaattttatatatatacgtattatttataacttattataatagtaattagtcaaaattattaaaaagaataccctttattaataagtagttataattattatattaaatattttaaggcttataaaactaatataaatacttagttctagttctaaggaactaaagacttaataatatagaataacatactatatctattttaaatagaacttgtcctttttagagtctaaaatttaagttaatataaaaaagttatatatatttaaaaaagaggattaatattaataattttaatctttataatttaggttagactcttatttaagatatttttaagatattttaatcctaagatataataaaaagtctttattctagattttcttagaggaagctaaagtttataacttttactccctatacctatatactagatactcttaaggatagacttcttatagatttagttttaaggtaatataaaggaggtaaataataaagaattttttagaatacttatatagctatagctaaaatagcttaaggtattaaaagatataattaaataagatattcctatagaaaaggtttttaattaaggattagagtagaatacggataaataaactacttttaacaaatattttagggatattacttttctatttattacccctctagtaatataggcctattaaagaagaaatactaattttactacctatttatattataataaggttaaatccctaataatttaaaattataagaattaagattattaaataaaatacctaatactaaaggctataattataagtaactagataaagtatagaggagtagtagtagagaaagaaatttagaatactttcctagtagctatatatattattaataagtatagttatagaagctctatagggctaaataaagtagaaaaatcttataatactataagaacttaatatactctaataagaaatctaagttttagaaattaattaacttatattatacttatttaaaaatatttgctaaaaataaatagactaagtttgaagaggtaaaaagagtagtatttaaagagtaattattttaggcttttaaaaaggactaagtaaggagaatattaaaagatatatagtagtaagggcaatagagattaaaaaattaaaaaaaggagtctaaattaggaaatagagaggaattaaatagagaaagagctataaaaaagggcttagaaaaagataaagaagaattaggtaaagagctagtataggtattagcctaactccttatagcctaaaataagtctaatttaattaataggaggttatataataacctatataacctttactaaggctattattataaaaagtataataggtagaataaagattgctaaaaataaaaaaatgttttactttatagttctagagtattattcttttacctatattatttactattttcctatatttaagtataagttctttttctagtttccttttttacttgtctacttctacttataccctttattaatattaataaggatattaatattctaaggggggagggaaataaaatagggaaatttattatataattaattagttagtttaaatagcctctttacttagtaagaattaaagaagaagttctcttcttttttttaagttttttgttttataattagtttttatctaaaaagaaccttaattaaatttagtattctatattttaaatctatctttaataaggtttgcttttattagtaaaagagttttatttttattaaagattttaatatcttctttagtaaactataagagattattatagaatcctagttttctttttaaggcttattatatagcaatactatactaattccttagcttactcctggccagagctttcaatcaaagtcctcttgcactagactcttagaaataaatactagaagtatctagtttaactaagatatattagtcctttatctagtagattcctagtattatattataatctttaagctttaggaatatatataaataaatatagggttatttatagtatttatagcccttaatatctaaggagacctttataattttattaatagtattactaagtatactattatatctttttataaagtaaatagagatatacttaaactaatacttttaaataaaataataaaagataagactataagaaaatacctagtattaatacaagtattagtatagtatattttatttatccaattaataaataataatctattaatttcttttttttaaatcttttttattcttttataatagcttattccttttttaataataccttttaataaaggttactctttttttaaattctcttttataattataatatcccctctaacttaagcttataaataataatagtagtagcttagaattgtaatatatacttagagatagctaggctataaaaatttatgtactagctatagaaataagaacttaatctatatcttagtaattttcttatctttatttcttaatctcttttttaggtatttatttagccttattacttaagattaactaagatataaaagaggtttttaaaaaaaggcttcttaaaaaaacctctttattttagcctaagaggctaaaggctcctagtttataagtttaggtctactaccttaaatctatataggttaaatagatactagtatattttaggaggctatagaggtctatttatttattatgtactttaaagtaataatctttatataaatctactttattactagtaattaatattatatatatgctttaattaaaggctatattaaaataatcttttttaatattatcttaattatagcctatttctaatagtaattaatctagtttaaataatagtttattaaaagaatagcttccttaatatagggaatatgggtaaataatagcctttttttaatatacttaatcccaaaataatctttatttatttataaaggttctttatagtaagtttctctagatttttagagtaaatattgatttataaagtaatttaatagtaaccgttttaataagatatattatatataggtcttcttatccctaataatatctttattaaattttaacttagcttataaagtaatcttgaaaataaatatcgggctaggtcctctttattatatttcttaatattaggtaaccttagctcaaaccttttaataaaggatataatagtaagtaatatatgagtagcttaagtaatatttattatatttaaatatatagtactagtaaatgtacttaataaaattagttatttctaactcttattattattattatttctttctataataacagtctttaaaggtataaatagatatataatgattatatttaatagctttgattaataataataattaatagctataggctattataattattataattattattattattcttccattttagagagcatttttcagtcagagactatgcacgctctgcctactacctaggcagtagggcttagtagctaatatctatatacaggtgggttatgctatagaccagtcaacagtgggaaccttctatgagggacagaaataggaaataagagataggcagtagtataatatgaataaaaagtcaaggaatagtaggtataggttgctttgataaagaaagaggggagagtcatagaataggggtggcttagtaagcatgattaggtaatccttatttagttattagttagcccctaggtgccatctcctagtagctatttttgattcctttaggaattcaactaggcttccctggccttctttagaaaacagatagaaaagattataatctcataccacaatgtctatattatatcctggcctttaattttaatcagattatatataggtatgactacttgtaagagaaatataaggttaatattatgtatattgctttttagatacccatttgttaattttacataaaaattacactgtattttatgttattccagtaaataatagagtagactacttctaatcaatgctgtatgctgtaaatactttataattatagtatataaaatatctctttaatatctttaaagcttgttgaggtatgagcgtacaaaaaacgcgttttgtatgggtattctagtgatcggagcaaccgggtgatcgaaacagccgggaaatacgttagtcggaggagaggcttacctaatataagaatccctaactataaggtctgtagtagtaaaagataaaggtaattccttagtatacctaggtgataaaatcaataaaattaataattaattacatattagatccctagacatactaccaatttataagaagacatttatacagaagatgatgatattaagattactagattgcttgatggttactagatacaggtgcccaagggcagtgagatactgctggctggcatataacctatattagagtggcaaagtaagttctttattaccttaaagggacccttaaccttgcccttacctataaaggggagctataccctctttataggtatatagatataaactaggtaggggaggtccctatataatacttaaccttaggctatatctttaccctaaggagtagtataattaattagttattaaagtaataaagctctatagtcttattattatataaaactaaatatataggggagatataggctattaaagaagctatctaggtctaatacttattaagatatctagggcaaaagccccaaaaaggaatagttatttatactaaccctaaccttaagtcttatataaaagcttatagccaaactaataaagagactatatatagtattattaagctactatattaattgtcttaaaggggaggatagtacctaattatctaggactataatctatatagttattaataataggtaaaagtaaataaaaaatattatccttttaatataatagaaatttattaaacatatagaaaaaagagggcaactaaatagattataataaaattaagatataagttaaatagggtaggattaatatcttaaatattcccttagatcgaagaaatagtactatttaaggatataccttttaagtataaaagactcaagaactaattatagattaagtaggagctaggtaatatagaatattaatataataggagtttagatatagtatcttattaattatctaaataagagtataaagtaaataaaattagctagttattaaatctattgactaagtagttatataataaagagtatataatagaaataggaagtaggaatagaaaagagaaatatttttctaataggtgctaagactagtataaataggctgccatatttctgcatagatagttttcttaattaacctttggctcctcacatacaacatacaacctcacaacaatagattttcacaatataatagttcttaagtaaatatatactaagcctatatatagcttatactaatattatctctaatttatataggtagatagaagagataattaaataatataatattcttaaagagtttagggttaataatacctagaggacttatagcaatattactagactagcctaataaataataaaaaaaggtaagtatagtttaggtatattaagtatatactaagtatatatcttagataagtaaaattgaaaagctacttagtattaggcttaatatcttaatttattatttaatccttaaaatacttataataaaaaactctaataatattattataatattaagggtattaatattattttagttagaaataagtatacctttggtatatatattaagtattattaagaaatattaacttaaagaatactatctatatatattatactatttaagtctataaaaagtatatctttagtatctactaggcattattaagatatattaaattagagaatactattaatatatatttaaataaggactatcttaagtataattatagataagatagtactaaggaggtctattaaataaggtatttaagcaaattaaataggtttaataagaataatagtatatattaagaggttaaaaataagtaaaaatattaagaaaaaataaagataataagaattagaaaaagagataataaacctatattagaggttaaaaatagatagagtaggcttaatatatactaagattttttaaagggcttatatattattatttagtcttagcttaagtatttattaaaaaaatattaagttaataggtaactaattttattttactaaacataataatattcatttattattatattataatcaaaaaagtttttaatctatatttataagatttattaaaaataatttattataaaaaattttttctatttatattactttatattaattattattaactttttatttatttattttctcatttatatttatatttattttttgaaattattagttttttcttttatattattagttttatttactctttattaatttataataaattattttaatataaaaataatttattatttaatataattaatatttaagctaataaacataaatataagaaaattaaaactttagtaattagctaataaaaatcttattttaagagttttaaagaagaattctactcttgtaaattatatcatatatttaaggctctatagttctattaaaagatatatttctctaacagtttaataagggctatatctaatttagacttctttattaatagagtaatcctatataaataaagaaattataaaacttaagatattactatagtaatttttaataaagatatttattttctataactaaaataaatacaattttaatataattaatatattttaagttaaaaggattaccaaaataaaataggtatattctaaatataagtttaatactatattaataaaaatactattcttaaataattgttaataagctagtagatttctatatataagggtataaaagttgttaattaatactatttttatattaaaaagctaattttaaccttaaataacttattatatattaaaatatctaaaattaatgtttttatatagggaaattaataataaaaattaattaaaaatattctaggaattatatattattaaatagtattaaggctaaaatttaactttagatatagctttataaaaggtatcgtggattatattaaaaccctccctatttctatttttagatttaaaataaaaaagataataaattatacttagataattatatttatattataaaaatagtaaaaggttatataatttatttttaattctaatttttaataaaaattagcctaatttttacctagttataaaagtcctaatatgaaaataaacaaatatttttatagttatttatattaaatatttataatatttttataaaatattaaaattataattatttatattatgtattataagattaaagttacttatttttaatataaaaatagtagctaaaaactggtatattatactatataaatagtcatttaatattttctctaaattactatataatatattattatatgattataaattttgccttttaagatttaataataagaatgaattaaaataactaaattatatcttatttattttagcctaaataatatataaaattaataaaatatttttaataattttataaaatatttataatctaattttttgtaaaaaaagtaaatattaataaataatactttattttaataaagaagatataggtattaattaaggagtagtttaagttttattataagattttttaagatctttataaattataatattaataatacatcttaatatactattataagaccttatatttagtatttttatataaaatttaaattatttaactcttttataagcatctaaataaatacaaataaaaactttaaatttaaataaattaattattcttatagttaataataaatttacaattatgttattatttaaataagtatttaggtagtatttatatttaacctcgaattatttttacaaataaaaatcgttaaaaggtaaagataaggtaactaaaggattaaatataatttaatttataattagcctctatttaactaaagatttatttaatatttttaagaatattaatttagggtttaattatatctgtaaaaataattaaattaataatatttttaatagcttataattataataatatatattaataataaatatttataatcgtaaagcctcttaaagtttacaacttaataatatctctaattatatgataaaagttatatatataaagaattataaaaaattaattaattaaatattatataatagcctacttatttatattttaaaaaaattttttatttttattttaggtcttaaacaactcattatatattaaagacttattttaattaaaaatacataaacctataaatattaatattttaaatattttaagataataaattataaattctatttaaaaagaaatataaaatattttttaaataatttttattaataaatttattaaaataatattataaaaaataatttcctcaaagatctatattttacttttttaaattaaatattattatttagtatatattccagtttttaagtaaaattaatatattctttttatatttaaaaaattataaatgaaacttctaatatagtttataataaaatataaaataaaagccttattattaataaatttcttttaatagatttaataaaaaaacattaaaaaaattataattattatatttttagattgaataattagtaattaattttttaaaagctataataattaatattatagaatataaagattttagttaaattaattattaattagttaattactaatctattaattaaaaggttatataatagggagttataattaaagcttaaggaaagaataaaaaagaatttttttaataaatactaaaactagtataaataagttaatagatttttatataaataatttttgaattaaccaatctaattctctatatataatattaatcttattatataattatatcatagatttttattaaatcataagcctaaagaggctttaaagctataaataaatattttttactaatattcatataatattataattataaatataaaatatattattaatttaaatagttataaaaaataactacttttaaattaacattattaaaaatattagataagtttttattcaagatattaattattttaaacctatgtctcttaattaatttattttattttttaattattaatattatttacctttttaagtttaatataaagatagtaaatattacctttaattgtatctttaaatataattaattaattatagactaaatattattaattttacttcttaatgacttattttaaaatttaatttttaataatataatagaatttaaaatataaataattctaaattaaaaattagccttttaaagcttccaaataaataaaactaataagaattaataataaatatttaataaaagtaatataaggtttgattattatactaattttaaaagtaaagtataattaaagaaaaataagaaaataagatatattagatcctttaagattaataattataaaaatctttttatatattaaaagccttatttaaagatttttcaaaaaagactaaaaaagtttataacaataaaaactaaataagtttatatattataatatatagctatttaagcctaaatataaaagatatttttaataagcttaaaactataaaagatctttaataaattaaaaagttatcattatttataaaattaattatttttaagtatttttaagtactttattttaaggcttatattaataaagatcttataaaattaagtatataatgataatatttggaataaaggataatttaattatatcatataaggcttagattaatacaaacttttattctttaaagtatacctttttataataagatatatatctttagattcttaaaaagtactaattaaacctataatatatcctttagctaattaaaaactttaaattataaatctaatattagtattttagctatttagataaaaagaatactaaataggtataaaaaatattagtattaactactcttaattatttatatctttttatattaaaaaatatgataaaagaagatcctcataaatataaaatgaaatattttttaacttatttatattaatatttataatccttttttaaagttataatagcttctatatattaggttattttaataatttcataaataaaaattatattaataataaaaacatcctttattaagtttattctaataatataagagaataataatttataaataattatttattttagaaccttttacttttaactaatattaataaaataatattaaaagcttctctaataaacctatttatttatttaggataagacctttataacttatttaaaagtaatttaataaatacttttaattatacctttaatacttaattgataattaatacctttattatattactttagaatctagacctaaattctagattttataataagacctatttaataattataaaagcctttatatattactttaaggtatggattaataataataaatttgataaagaatattattttatttattagacctacctttatagcaataaaagagagttttattttattttaatctagttatagttcttaatttaattagcctttataataataattaataaatcctaaaggttagttactaaaatatattaatataacgtaatcaatcaccgagcgaaacagatcaccgagcgaaacaccccaccaaactacgcgacgcgctcatcaacttcaaccaccaaaatgccacgcaaaacagcagattcagcagttcatcaagagggccgtatcttgcttgcaattaaagctttcaatgatggtcaatttaaaagcatacgggctgctgcacaggcatataatgtgccacatccaacactctaccaccgcctacgcgggcgtactgcacgcgtagatgcaacaccaaacagcaaaaagctcactaccactgaagaatctangcttgtttgttaaatccacctatacctactgttccttaacatttgattcttacattatactacagcctgtctctcattccctatttctgtccctcatagaaggttcccactgttgactggtctatagcataacccacctgtatatagatattagctactaagccctactgcctaggtggtaggcagagcgtgcatagtctctgactgaaaaacgctctctaaaatggaagaataataataataataattgacaggtgctgaaggacagcaaaaagctcaagcaagtacaggaatcctagaccatggactcgaaggccaccaagatgcagtaattgcaatcaaacaggccataatcggcttaaatgccctagtaaatagtctccttctttatatagtcaaatttattaaatttggttgcgaaatgcttcaagatttacggttgtgctggtggttgaattttttctcagggaccgcgcagctcggtggtggattacgttatatataatattacttttaatactaataataaccttatttatctatacctgcttcttaacaatagtctagagggtagttttaatctcttttagctctttagtaacctcctagactaggggtttagacttaactttttaagttaatataaggattaagtctagtaaggaggagaagagactaaataatttaatagtaggcttttttttattattagtaatagcctttagctactttatattattagtaaaaaatctatattatatctttttaaactaatcttaaaagttattaattcttataagatctttattaatatgtcctaaatatagagattaattaaaatatttaagcttataataaatatattatatagctttaatattaattataaaaatattattattattataaagctttaaaaaagctattataaaagttacttctaattctagtttaattaggcttattatagcttaatttctttgtaaatatttataatctcttttaattttttttaattttaagtatagttcttaataattattttcaatattaaggctagtacgaaggctaagcttaagattatacttaaggttataaacttatcttaaaaggttctcttctaaaataatattattttcaaagaaaaatataatttagtcttagtttattcaaaaaggtattaatataataagcctttaacatattataattgtagtaaaatttcttataatttattatagattttttaatttacttaatatattttataatatccttataatttcttaatatacttattttatttcttatattaaaggttagaaataattatatctttacaaataatacatctttaatctattaaagatttttttatatttaaataactttaggttaaatataagcttattaaggttatatattatattatatgatattaggtaatttttatattaatctttaggcttatattataaatatataaaaggctaaaggtctaaatatttaaatatgagcttttaaatatactattttatattaactttattatataagctttaaaagacctttttctaggcttctttaaaggctttatatataaaaaggcttatatagattatagcttataaaaggctaagtctagagtatttataggtattaataagcctaagtagtcttcttttttaagcctaaataaataagttattaaaggctaggctttatatattttattattaaagtaattaatttatatataaaattattactatataaataggttttttaaattaattttttaagtttttataaagtatattagtatagggctcttaattttaatataatatatttatataattatattatataataattatataaataaattttattattttataatatatctaattaagaaaatatttttaataattatttataaataaatagctaatataataatattattaaatactaactattctttaataaaatattgtttaaataaaaatatattaaatccttaattaatagtaatagaaattatttattaataaatttaaatataaatttaaaagtatatagtttataaactttattattaataatttaaattaatttattatagttaccaattaactattaaataagccttttttatttatttttttaaaattaaggtatattctaatatatattatatttaaatttatctaaatattatttttatatttataatattaaatatataaagtattcttaagaaataattaatcttatataagagtattaattaaagcttttaatttttactattataattaattaaagtagtttataaatattattataggctttatttaaatttaattaattatttattatttactaaatatatataatcttgtaaaagtattataaaattataaattaatataaaactataaaatctaatatattaaatatttaaatatactgtcttaaacccttttatatatttataatacaggtttatataaagcttataaaatattaatataaatagaatataattatgaacaattaaaataaaaacttattataataataacccttataattttagaaatatacttttattattaattataataaagtagattaataaacttaagaataaaatatataatattattatataaaagtaattattttttaattatataatattaattttattatatttaaatataatataaaaatatatatttttattttaataataaataatcgtaacttattttatataaataatattataaaaattatataaataaatataaacaatgtttttattatgatattatatattatatatttatactttaatcatattaatataattatttttagtttaaagattaagtggttttatctcaaaatatattatcttaaataagtatttcttctctacctagaatatacgagaatttattattactcttaaaaatactattattagttttaattttgacttattttactgcctttatccctattgaaactattcttaatatatatctagtatatccttagtagatatatacttttatagaggtagctaggactatattttataggtatcttatttatagctacctttaaaatataaataataaggttcttaatactatcctttgttagctttatatatacttatattatatttaacttactactattactatcagggctagatttaaataaaaagggaggtaaaaactaattagctttataacttagctatactttaaatactataaataattatatatagaagaataactttaatccctactaaatatatattaagtttattctagttattatatagtagttaatagggataaatatataatattattttttaaattagctaataataaattcataatacatttatattaagtatatactcaatatactaatagtctaaaataatagtaaagggaaggctataatctaaataatgtatgttttctaggaaaaatatactcacttgtatttatatatatgctgattagtctattttctttactacttgtaagaagctatagtattctataataactaattatatagagtaggaactctagtattcgatagtaactatctatatagtttttggtttcttagttttagtaacttatttttttatccttagggaggtcaaattagatttatattagtctaaatatatctatcttatttaggctctatttctatggatatccttttaagcctcttttaccttcctatctatatagtctttacctcctactctttcccctttagtcctccccttctataatctttattactacaggtatcttattatttagctatatcctatttaaatcctatttgactttctttcttaggtattattatattattattaggacaaatcatatttatatcttctacctagctaaggtctatattaggattattagggatgggcttatacatgagcctggctagaaaagttcagcctggctagagcttatctgcctagtatatattaagcctagttagggtatagtaaaggcctatatatagtagctttatattagtatcttttttatttataaatatttatatactctttagaaaattagacttaattcctcctattattactttatatttctttattacttctactaaaataatataataggaagtaaataaagttttaaagaccaatatataatatttttaataaaataattttagaattaaatttttaaattttagataatttttatattattttattttattaatatatttagatatatatatattttatgttaattttttaaagtttatagttatataaaaatataatatctataaaaggttaattaaatattaaagctgtttataattataagtaatagtatatttatattatttttaatattttatataataaagtttataaaagagcttataaaaagcttataaataaataatataaagtctaatattaagatcaagatcttattaatctttatttttatatatttttatttttttaaccatgattttttaacgctttatataagcttatattataaatatataaaaggctaaaattctaaagtatttaagtataaatattttatatattaggatttatattggtgaagtagatggagtcagccagttactaatctgctggttgagaggtcagataacagggaagtcatatggttagagcctaaggcaggaatagaagaatatgtttttaataaattctaagactagtataaataggctagcagactcttatatagatagttttctaattaacctttttaactctctataactatagatttttactaggttataatcctaaactagctctagggctatggataagtattttcctactaatattaacttaatactataattataggtagtctaaggcattactaatctaaataattataaagagataactaaacccctaaactaatattactaaaatattaaagaaacttttatttaagatagaaactaattataacctaaactagagatatatatatctcttaattaccttattttttttcttagctactaaatttttacctataaactaaagaccaaggtataaatattacctatctacttattaaaatattatcctaaatataaacttaatattacttataataatatgactactctaacctactactttatattatttcttagacataaattgcttcacctttatttatatttatctagatacttatagaggaattaagctttttagagctaatataaaggatattaaatactacccctcttctctattattagatatagttactaatttaatacctttaatactaccccctaataacctaattagctttagtctaaataccccttaagataatataataaagcctaaatataactaaattaaaattagaatatacctactctcttaatttagattctttaaattaataataattaataaagattaataataaaagtaataatataaggtctagcctctatatcaattcttaaattaagttatagctagataaaataaaagcaagatatatataatgtaatcgggcaccgagctgccacgtcatccaccaccaccccctaatcaaatttgatgcaatttgtttttaatgcaccatgccatggctgacatatcaaaggaagggcgtatgcaattggcaattgaggcctataagaaaggtcttttctcatcaaaaaaggcagctgcagatgcatttgacatgccttgaaggacccttaggacgcaccttaatgggaccacttgcaatgattcaatggtaaattgttgaaaattgacagatataaagaaactatactttcaaaatagattcttgatatggaccgatgtagcctacctccgcaaatttcaaccatacacactatctggcacagctattgctctctgcacaattatcctcagatgctactgccaccattggtgagaaatgggtgaaccaatttattaagcgccatattgagctttgttctaaatatacctgaaagtatgattatcaacaagcaaaatgtgaagatccagagctcattaaggggtgttcaagtggtttcatgatactattcaaaaagtctgtgatccttaagcaagatatctacaatatggatgagactggcttccaaatgggtatgatttcaactgccaaagttatcagtggatcagaaacacgcgtaacattagctaaaatgaatggatgaggatgtccaagcgatgaagcaggttgtgagcttgcctggttgacttttacatgtgccttgtgttgtggtgagtagccacaggttcctctgttgatcatctcctgacgataagtgaaacagtttgcaaggctaaaatgtaatcacattgctcgtagtggtttgctgttctcagtctatccagcagtcctgcagccaagtgagtagacacatggaagatccatgcctatgtggatgggcggctaatgctgccactatcaatactgggaataatagtcaagacgcctcagtttgccaggggttgttctacgccaaagtcacaagaacagagccccttgacagcagggaatggtgattaaccctcagggtaatgggaagccttgggtaaactagggttataagcggagacaggttctgaacaagggggtcatggagataaagctggatattttggtagaagagaagcaagtagcagccatctgactgggcgaccagacattagtttgaaagccacattgtgcccggacacttgtaaggtacggtatatctcctcctgagtataccatttgtataccctacagcggtatgctgttgaggtcttccagggcctttctggtatacctttcttattattattattattcttccattttagagagcgtttttcagtcagagactatgcacgctctgcctaccacctaggcagtagggcttagtagctaatatctatatacaggtgggttatgctatagaccagtcaacagtgggaaccttccatgagggacagaaatagggaatgagagacaggcagtagtataatgtaagaatcaaatgttaaggaacagtaggtataggtggatttaacaaagaaaaagaaatgagagaaagaacagaaaaaaaaaagggagtcaggataggagaggtggcttaataagcatgattagataatctatacctagtaagcctggttctatggggagctaactaaatatagctactaactaagctattataattataagccttatcttgttataataaaaggggatattatataacctaattaaattaactattataatttataagtttttatttttatttaaaatatataatttatattaaaaataatatataaaaaataaaaatataagctaatttttttagaattaatatttgatacttatattaaattaattaattatataaaggtaattattaaaaaccttatttttatatttcatattttaatagattttatatattatttttaataatattataatattaatattttatatttaaatgttatattaactttttatataattattaaattaaaaatattttttattgtaaaaataaaattttcaatatatattatttatcgcaaaaatctatggttatatagtagcatattatatatagagagttagaaaggttgattagagaactatctatatagaactctgcgagcttatttatactagtcttagttaatatctattaaaaaatattttttctagtcctcttaaatacattctcttttttatatatttaataaatttttatctattaaaaaataatattctttatttatttctatttactattaatagctactaggtatagattataatcctgaataactaggtaatattctcccttttaggacttaattgaggtaatagcttaatagtactaagtatagtctttttattccctatctcttatatataattctcttatatataattaagtctatatactaaagagtactagctaatgtatcttattatttaggtatagcctatagtataaataattataatgattatagtttagtaatatagatatttaactaacctttaaatatttattagggaaagatattaagtttagatagatatataataggccttgtctttaaaattagtaaaaaaaaatctaaaagccctaatataagtctttaggttagttaaggataaaatgagagctataaaggtaaagtatcttagaagatatatttaatttagttaaagattgattgattgattcctacttagtttgtcagccagcaggttatatcaagtaatatatatagtctttataggcttattttttatttttaacaattatattaggtaattcttattaaaagggtattataaagggtttaatttatttaaggttatctaaggggctttaaaataaggactttagctaatactctagcctcttaaaaaaagtataaaaaagtcttttgttatatctattcttagtatctaatattaagatataaaaatataatctttagttatctaccttaaaaatactcttaaggaaaggaatatatagatagacctctttaagatataatataaaaaatattacctattatcttaaaggtatagtattaaattaattctaatactttatatacctattttagcctttttaaaattatatttagcctagatatactaggtaaaatatatatatagaatcttagggagaattatagcaaatatattcttttaaaacagattatatattttaaataaagtttataataaaggataatataatagtttaatcaattataataaccttaagataataaatatatttagtattaaagagtatttaatctaaccaaactcttcgatacttaactattaatttagcttttcctatttatatctaaaaataggaaaagctaaatattttaatttataaggtttaaaactatattaaggttaaaatatataaatacctatatttaaaggggggcaaagtaaaaaggtatattaagattcttatttcctaataatactataaatattttacgttttagttaattagattttactatccactaatactttttcacggagagctggcaggggatcatcaggaaactcatggccttcatgcttttcgagtgcaatttcctgaagcttactgaagtcccacttaagccctcatgactgcaacttgtgcccaaggcatcaattcgaaatctgtccaaggaattcgttcaaatccagagcggggagtaaatattaatgcttgcaaatcgttgtgggtgtgctctgcctcgacgaaaattaggcatgacccagcatcatcttccaagttgaagtcctcctccttaggaaattgctgggaagtgaatacagcatcccagacagattgcaagatggggaggcaatccataactgcagaatgttagcgcaagaagcagaataattggctaaggttcaaaaacctagcaattgatatttcgacatacaagagaaaataaacccacctatagatatcggcttagccgtatgtttgtaattaaaaatacacgggcgattcctaacaacagccaacaattatgttatacgaggtaggcgacggcaaagcgaaatggaactaagcaatattttaggctggccaagttaatggaggtaagtaatgcaagtctggtcaggattgaaattcaaggcactcgtcgagcactcagttgcaggaggaagatcatcttatatgatcaagccccggattcatgatctatccattatctgaagttctagcaaacgttatgcatctagtgagacgctgcgccttagaactactaatttgtaaagaaagcctagtctacgtccataatgcaggcaatagcacattgtctataagcagggtattatgcgttgatagatctctcgtcatggtttcgagctcttgattggcagcatcacaatcctgaatgctgttttcataccactgcatcctcacagtctgtaaggtcagcatccatcatgcgtcagctctagcatgctactcacgattaacttggtgttggtgttgcagctcttattcagtgagagaaaaacgatagccgaatccaaaataaggcttgactggattctgatgaaaccttataataagcaaagaggctcagctgtcgtatccattcttcaaacttcgttgtcataccataatagccgagccaggactggaatactgattcctaacataaaaatactcaaataattttgatacctatctcatctgcgcagcactggcaagacatctgtggtacaatacgcatgaccctagaaacctagaaattgagaagcctcgccttgatggccattcctgccacgaaaacacctacgccgaccgcagaaccgatcacgcaacaatgcctataccatttttacgagattaaaatattcatcaaagtctttacttttaggtatcttaaataatcttaaattcattaaaccttttatagccctcctttaataagagttatttaatacaaatattttaaaaataatgaataaacttaagtataaatattatatatatctaaatacttagagcttgatattcttattattaacataagaatagggtaaataaaatataagggctatagctaccttatattaaaaaataaatatattataatttaaataaaatattaattatttacattattaagcttaaaggtattaatataattttatattaaataatctaggttattatttgaaagttttataattaattaaaagaccttttatataatctttataaataattaattataaaagtttattataggcttaattataatttaaactaatataaaaaataatattttttaatataagataaatattaaagctataataaatactagactgcataaatatatttaaagaataaattagctaattatgaacttcattaacattaatattttcctttttaagtaaaaacctattattactttactattaatattttaaaaattataatattagattaaaaaatggtgaaatagatagtcagtcagttactgatctgctggctaagagtttacataatagggaaattatatgattagagcctaaagcaggaatagataaaagaatattttttttaatagatactaagactagtataaataggttactaaacttttatatagatagtttgttaattaaccttttataactcctaatatatataatatgattttatataactacagatttttactaggttataagcctaaataagctttaagactataaataaatattttcctactaatattaatataaccttataactaagaactattaaagtattatttaaaaaagatacttaaacttttaaattaatatagccagaaatactagaaaatattttttaagttactaattagaatctaaaatatgcttaatttatttagctactttatttttgccttcttagcttctaaatttttatattagaaattaattaaagacagaaatataaatattacctacctacctattaaaatagtatcctattcttcagcggtagtaagctttttgctgtttggtgttgcatctacacatgcagtacgcccacataggcggtggtagagtgttggatgtggcatatcatatgcctgtgcagcagcccgtatgcttttaaattgaccatcattgaaagctttaattgcaagcaagatacggccctcttgatgaactgctgaatctgctattttgcatggcattttggtggttaaagttgatgagcatgtcgcgtagtttggtggggtgtttcgctcggtgatctgtttcgctcggtgattgattacgttaggctaaattaattagataatagactaataatttattataagaatttgactatattaataatagatttataaatatagatacgatactagctgcagagaatctaataattctatatctatatttgttccttgactatagattcctatcttatagctaaatattataatctatttaatagcctattataagattactgatagttatagggatctattactaatactaagtcacctattatagtttattattctatataatctataaagggcatactactaaaataacttagagataaataggctatagagactatatactattataaaaagaagaactaaggtcctatagggggtattatatttatagttatacctttatatagtttatataaattaactaaaccctatattaaggcctataatattattatacctaagatatataaggaagccatcatattattagaataagaataatagatatctataataaataattagatatagaagttgattagaaagggtatataggagcttatagacccccttataaataaattaatatatctcctgccaggtaaataggtctttgtaactaaaatagatataaataactatattatagaatagcatatataataggttatatataataactattaatagcctagtaaggactttaataaaacctactacctattgtttctaaatctactattaaaatcatcctctttataattgctatttataatttatatactaaatagtagactttataactatatatcttaatatacagatttataactataaactctatatatggcccctaactaaatattttaagaaagatggcaaagtctatttactcttataggctctatatagcctatattagaattatactctaaataagaaactataatctcttagttttaaactgctctataaagatagttatatatatatctagtataatgctaaatcctttgctattatctatattaataatatagttatccttaactatataggctctatatattaagaagatccttattaatttgaatataaaggattatataataaataaactgctaataaaccctaaatatgctagatcctataataataataatctggttataaataatacttcctatctatatattgttagctaatttaattagttaataactaaggcttatctagatattatatatttataattttatatttataataatgatctataaagcctattatagctaacttataagcctataagggccttattttataatttagttaatcatatattcttagctatttataataattagtttaaatagctttagctatctaatataattataataggtttaaaagggatatataagactagatagatattataatactttaaggttaagtataatttatatatattatttctccaggtattaataacttaaaatagcccttataatatctaatattatttttagatatatagctctatcttttatactgtaatttaggtttttaggtttaaaagatatatttatttataggttatataatcagctatataacttatattcatagattttaaccttttaataggttatataagtcttaaaataatattttatatctacctctatattatgttaaaaatatttttaatagattataaagagtatatattttaccttaaaatacctttttaaggttattataatttatttttataatctttagttttagggctagatctaagagaatatatattatactactttattatagtagaggagactatttttatttactctttattttaggtatttaatattaaagattttagagttttaaagcttctcttttatgatggaacccaatctcattcctatctaagtggtttgaggcagttaaactataagagactaagctagggaaaggaaggagggagaaagaggggtagaagttagtaggagggaaatattagaaatactgcctagtagaactattattaccttttatattacttatataataatatcctacatatacttatctaaaatacctagttatagactattatattacccctaattaagaagggagcctatccttaggtaatatagtttagataggttagggtattagctagttattatccttataatcttttagaaatatattatcctctactacttttagctaggcatttagttataaaaagggatttaaggcatctaggtactaggtataaaaatcctagatcagtatagtatattccataaaaaatatataggatattacttaagattattattatagctaacttatttaatataaagagtttttaatagtaaacctttattatgagtatttatttaatctcctattctattatctattaaccttaataagcagctatttatttaagatctatttttatgaaagttttataaataatactttataaagcttttttaatatagactaaatagatatagatattatttagtgagttaagtttaaaggtatacctaattttcttaataatctaaaaaagactagcagcctagttataattataagcttttagctaggttatcctattctttaatccttagtaattactattacttagttacctatattaaaattaatcttataataatagtaattagtttactatttttaataatattaaagcctattttattctaatataaactaatttctaattctttttatatcctatatctaatcttaagcctattcttaagttttaatccttatagagataaggctaatttctaattaaataatacttatcatttacaactaaattctactaaaaggagtaagatacttatagaattatataggagtattacttctataaaattaattgttaggagaagtttagactaattattttaataatagttaataaataggtataagtactaggctatatattagtttataatctttatctacctattagtctataaatacttatttatagataactttaattttatattaataaattatagaatttatcctgaaactaagataaactaccccctttagttagagataattatttctaaggccctttgctattaatagatatattttataaataaatatattatttctaatactataattatcttataatataggattaaaattatatatttatttagctagtctactattataaatactatattaaagctatatttatttttaaagaaggagtagaaatctattaagatatagtattataattatttaggtataaataataggtttaagagttttagggctctatccctttatatataaattcttttataaactaagtagttattaatataattaatatcttttccttaaataggctaataataaataacttattaaacctattattaaacataagctaagtctccttttatctttaagtataataacttgtaatagctataaaaggaataggattatttattaaataattattaacctaatctaggatacctaatagatcttagaatacctaataaaatattatgtaaaaggaagaataaaagtaatatataaggattatgtccttataaagatagtattagccttaagctttattattaggcccctaattactagatatgtttaggattaaattaactaaaagtaccttaatattttaaaatagtataattaaagcccccttatcctagaggatactttaaataaagccattaaatatacttactatctaagcctttactattatagttaagataattaccttaataactaagattattaatttctcctaccttagctatatactagaaataataaagcttaaatataagactagataggcttataaataggctaaggctataaatttaaataaagattaagaaacctttaagtaacttttattataagttaggctataagattataaaatagctaataccttttataaatagtaaattaaaaaagctatatatataaaagggtttttagaaactaataaaggtaagctaggtcttataatattctataactaatttataccttaaataaagagggctattaaatagatactttaaaagctaaagtatacctctttaaataagtacttttctaattattattaaatattaacctcttagactcataaggcttttattatcttatactaaaggtcttaaagataatatagattaaaatctaatacattattaaggatactatattataaaaagtattaggactaaataaaatactaaacctagtactatagaagatatttctcctaataatatattagctactaagcctaaataagatatctttagagcctttaataatatctcttatatatagctcttttataatttaaagaaataataagtcttaatataaataatataatagattaagagcttcctttataaccaataattataactttatttaagggagaaataagtaaatttaatattaatattagtatcttttaaggatcccttttattacctatcttctacctcttttataatattaaccttattaagaacctataaaaagagggtaatgtatataataagttatattaataatatatatcctaatctaaaggctaatagtagaagttaattattagaaattaaagaatttatataaagttataaagaaataaaaaaacctaatgtatatcctactttatactatctaaatatcatcttatatacctgctctacctttataaggggtttaagctattatagattaacctaatatccttattagatattaaaaaaactagggttaaagctaagataataataaataccttactatttggcttaactagttattattagctataaagtatatatagaggcttaaaataagagtaattaacctaattatagtattattatttattatataattaatataaagaatatgatattttatttaagatatatttattagtaatcctttttaagatattctatacctatttagcttagtatatttaggctaattataagtttaaaaaggctaaataagaggtttataaaatatttaaattaatataatattaagcattaaaaataataaaaagggccttctagataatattaaaacaggtatttaaaatctacttatatattcctctacctatgattctactataaaaagctattaaaaatgcctatctctaaattaaggtattcaaaatatattaggatattatagctattagaagcaaaatataataaaacttattaattaatatcctaaaagaccccttaatactattattagagtagctaaaatattatttataggtataatttaaataagcctttaataacctaaaaataattaaactatatattatacccctatagtaggagctattaaaaatatatattataaataataaagagactaccttaaaatattattattaggccttataataattaaatatagttattatttatattaataatagtagtactactttaggagttagtattataataatatctaacttaggtatataaatacttaagtaccttagacttctttataatttatatatatttatattattaagctataaaagatataaagaaatgtcagagatgtcgatgaagagaagtctgatttgggtagaagaagccaagtggcacgtctatataataggtgccgaagctgactaagccggaaaggggcaaaccgaaatctccgacaagaaacaatttacttgtactttcttaaataagaaaacctgtaataagtagactagatataatctttctattaatattgtagtactcggtttctcctaaagctactacctatttttatagcaagagatagataccctagaggattaagtctctatactagagttattaattacctttcgaagaatgccgacagtttcctctagtctagcggggttagaaaatctcagagtacatttttctaaatattctaccatcccagggtaaatacttggtagctaacatactacacagtttaatctattcttaatttttgaataacagttagtatacagttaatgccgtctcttctaggataagatattgccaagataagtaattactttgccttccacctccttttacaggtagttatttaatatactctctcaattcaatgactctctaaggctatatggcgatggatagctctgtgaatctttctcaaactccgaagaaaagatagattcaggaaagccaaatgttgctggtgtattgaggcttggtatttctttttagagcaatggtgatacaacttggttggggattaaagaacactatcttaaaaggccttccaggattctttcttacattcctttctcttttatactttccttatctcaagcaatatatcacaagatacaattctgtaaaggaaaaacacggtgacttgacccagtttcatactttctctgacccatattacattggtttatacctaccgatgaaaacttaggtttgacctttagtgttgtttcccacctctttgcatcaattctctatgcccccctttcttttctattctcgtttcagggccacggcgacgtcagttgtaatgccctgaaattagccaagtcggagaaagggagtaggaccatcgctggtaagcatacccctcaaaacactgagaaaccgatatggcctcttcgcgccacgcacggttcgctcctcgactttctccttttaaattcgacttgcaaaagattctcttggcatgcttcactctctgcaggctcttcctctaactgatttggtttatgtaggtaggtatctgatagttcggcatgcccgattcgtctaatctgatctaggccggcctgtctctgcgcctcatgtctgccagctgtcaagtgccgataatatctgcatgccccgccgaacgtgccgagcagtttctcgcggcgaaaaataggggaacttccccacaattgagaagatacgatacagaacaacggactcttttctcttctgcagctactaccgcattctcacaaccgcagccatggtcttcacgtcttcttccaaggatatctgcagaatcgaaccccgcgacgggttgtctatactaagttgcttgccacctgcaagacggacaatggacagtgggtgcgcagtgagattgacctggatgctttcctcggatatgatccggatcatcaggagttctgcatgggggccactggtgggttcaccgattggttgaagccggaaagcatctgcctcgatgcaggaggagcgattctccacggcaccacctccagcggtagtaaggaggtggcttttgcctgaatttttttcgtccacagtaacgacggccaattggaaggccaaatgccgtgagttctaat

SEQ ID NO: 4-6 - skipped (3 entries)
